US010655110B2

(12) United States Patent
Sonoda et al.

(10) Patent No.: US 10,655,110 B2
(45) Date of Patent: May 19, 2020

(54) MULTIVALENT DENGUE VACCINE COMPOSITION COMPRISING A MIXTURE OF ATTENUATED DENGUE VIRUSES FROM DIFFERENT SEROTYPES

(71) Applicant: KM BIOLOGICS CO., LTD., Kumamoto (JP)

(72) Inventors: Kengo Sonoda, Koshi (JP); Yasuhiko Shinmura, Koshi (JP); Susumu Yamaori, Kumamoto (JP); Motoharu Abe, Kumamoto (JP); Shinichi Maruno, Kumamoto (JP); Shota Takagi, Kumamoto (JP); Yasuhisa Hayashi, Sasebo (JP); Kazuhisa Kameyama, Kumamoto (JP); Fusae Komura, Nara (JP); Aki Fukuda, Kumamoto (JP); Naomi Uchida, Kumamoto (JP); Masaya Yoshimura, Koshi (JP)

(73) Assignee: KM BIOLOGICS CO., LTD., Kumamoto (JP)

(*) Notice: Subject to any disclaimer, the term of this patent is extended or adjusted under 35 U.S.C. 154(b) by 0 days.

(21) Appl. No.: 15/778,368

(22) PCT Filed: Nov. 25, 2016

(86) PCT No.: PCT/JP2016/085077

§ 371 (c)(1),
(2) Date: May 23, 2018

(87) PCT Pub. No.: WO2017/090762

PCT Pub. Date: Jun. 1, 2017

(65) Prior Publication Data

US 2018/0340155 A1 Nov. 29, 2018

(30) Foreign Application Priority Data

Nov. 27, 2015 (JP) ................................ 2015-232013

(51) Int. Cl.

| | |
|---|---|
| ***A61K 39/12*** | (2006.01) |
| ***C12N 7/08*** | (2006.01) |
| ***C12N 7/00*** | (2006.01) |
| *A61K 39/00* | (2006.01) |
| *A61P 31/14* | (2006.01) |

(52) U.S. Cl.

CPC ................ *C12N 7/08* (2013.01); *A61K 39/12* (2013.01); *C12N 7/00* (2013.01); *A61K 2039/5254* (2013.01); *A61K 2039/5256* (2013.01); *A61K 2039/545* (2013.01); *A61K 2039/70* (2013.01); *A61P 31/14* (2018.01); *C12N 2770/24121* (2013.01); *C12N 2770/24134* (2013.01); *C12N 2770/24164* (2013.01); *Y02A 50/386* (2018.01)

(58) Field of Classification Search

CPC ................ A61K 39/12; A61K 2039/70; A61K 2039/5254; C12N 2770/24164; C12N 2770/24134

See application file for complete search history.

(56) References Cited

U.S. PATENT DOCUMENTS

| | | | |
|---|---|---|---|
| 2006/0292172 | A1 | 12/2006 | Kinney et al. |
| 2007/0026016 | A1 | 2/2007 | Kinney et al. |
| 2008/0107685 | A1 | 5/2008 | Barban et al. |

FOREIGN PATENT DOCUMENTS

| | | |
|---|---|---|
| DK | 1159968 T3 | 2/2009 |
| EP | 1 159 968 | 10/2008 |
| JP | 2003-523189 | 8/2003 |
| JP | 2008-546382 | 12/2008 |
| JP | 2008-546383 | 12/2008 |
| JP | 5075120 | 11/2012 |
| JP | 5197362 | 5/2013 |
| WO | 00/57910 | 10/2000 |
| WO | 01/60847 | 8/2001 |
| WO | 2006/134433 | 12/2006 |
| WO | 2006/134443 | 12/2006 |
| WO | 2007/141259 | 12/2007 |

OTHER PUBLICATIONS

Fitch, W. M., May 2000, Homology, a personal view on some of the problems, TIG 16(5):227-231.*
TheiBen, G., Feb. 2002, Secret life of genes, Nature 415:741.*
Lai, C.-J., et al., Dec. 2007, Epitope determinants of a chimpanzee dengue virus type 4 (DENV-4)-neutralizing antibody and protection against DENV-4 challenge in mice and rhesus monkeys by passively transferred humanized antibody, J. Virol. 81(23): 12766-12774.*
Rivino, L., 2016, T cell immunity to dengue virus and implications for vaccine design, Exp. Rev. Vacc. 15(4):443-453.*
Miller, N., 2010, Recent progress in dengue vaccine research and development, Curr. Opin. Mol. Ther. 12(1):31-38.*
Rothman, A. L., Jul. 2011, Immunity to dengue virus: a tale of original antigenic sin and tropical cytokine storms, Nat. Rev. Immunol . 11:532-543.*
Chokephaibulkit, K., and G. C. Perng, 2013, Challenges for the formulation of a universal vaccine against dengue, Exp. Biol. Med. 238:566-578.*
International Search Report dated Feb. 28, 2017 in International Application No. PCT/JP2016/085077.
International Preliminary Report on Patentability dated Mar. 9, 2018 in International Application No. PCT/JP2016/085077.

(Continued)

*Primary Examiner* — Jeffrey S Parkin
(74) *Attorney, Agent, or Firm* — Wenderoth, Lind & Ponack, L.L.P.

(57) ABSTRACT

A highly safe dengue vaccine was invented that induced a neutralizing antibody response against all of the four serotypes of dengue virus without developing more than a fixed level of viremia with single administration. A tetravalent dengue virus formulation is provided that is excellent in both efficacy (neutralizing antibody response) and safety (viremia).

3 Claims, 9 Drawing Sheets

Specification includes a Sequence Listing.

(56) References Cited

OTHER PUBLICATIONS

Arunee Sabchareon et al., "Safety and Immunogenicity of Tetravalent Live-Attenuated Dengue Vaccines in Thai Adult Volunteers: Role of Serotype Concentration, Ratio, and Multiple Doses", Am J. Trop. Med. Hyg., 2002; 66(3): p. 264-272.
Monica A. McArthur et al., "Dengue vaccines: recent developments, ongoing challenges and current candidates", Expert Rev. Vaccines, 2013, 12(8), p. 933-953.
Jorge E. Osorio et al., "Efficacy of a Tetravalent Chimeric Dengue Vaccine (DENVax) in Cynomolgus Macaques", Am. J. Trop. Med. Hyg., 2011; 84(6): p. 978-987.
Joseph E. Blaney et al., "Recombinant, Live-Attenuated Tetravalent Dengue Virus Vaccine Formulations Induce a Balanced, Broad, and Protective Neutralizing Antibody Response against Each of the Four Serotypes in Rhesus Monkeys", Journal of Virology, May 2005, 79(9), p. 5516-5528.
Bruno Guy et al., "Evaluation of Interferences between Dengue Vaccine Serotypes in a Monkey Model", Am. J. Trop. Med. Hyg., 2009, 80(2), p. 302-311.
Wellington Sun et al., "Protection of Rhesus Monkeys against Dengue Virus Challenge after Tetravalent Live Attenuated Dengue Virus Vaccination", J Infect Dis., 2006, 193(12), p. 1658-1665.
N. Bhamarapravati et al., "Live attenuated tetravalent dengue vaccine", Vaccine, 2000, vol. 18, p. 44-47.
Usa Thisyakorn et al., "Latest developments and future directions in dengue vaccines", Therapeutic Advances in Vaccines, 2014, vol. 2(1), p. 3-9.
Lauren M. Schwartz et al., "The dengue vaccine pipeline: Implications for the future of dengue control", Vaccine, May 16, 2015, vol. 33, p. 3293-3298.
Database DDBJ/EMBL/GenBank[online], Accession No. ACN42676, Mar. 4, 2009 uploaded.
Database DDBJ/EMBL/GenBank[online], Accession No. ACQ44491, May 5, 2009 uploaded.
Extended European Search Report dated Jun. 3, 2019 in corresponding European Patent Application No. 16868705.1.
Anderson et al., "Interference and Facilitation Between Dengue Serotypes in a Tetravalent Live Dengue Virus Vaccine Candidate", The Journal of Infectious Diseases, 2011, vol. 204, No. 3, pp. 442-450.
Official Office Action dated Jan. 29, 2020 in corresponding Singaporean Patent Application No. 11201804317Y.
Corrected Official Action dated Feb. 6, 2020 in corresponding Singaporean Patent Application No. 11201804317Y.
Barrett et al., "Vero cell platform in vaccine production: moving towards cell culture-based viral vaccines", Expert Rev. Vaccines, 2009, vol. 8, No. 5, pp. 607-618.

* cited by examiner

MULTIVALENT DENGUE VACCINE COMPOSITION COMPRISING A MIXTURE OF ATTENUATED DENGUE VIRUSES FROM DIFFERENT SEROTYPES

TECHNICAL FIELD

The present invention relates to a dengue vaccine containing an attenuated dengue virus.

BACKGROUND ART

A dengue virus infection has, as a specific infection, the highest incidence rate next to the world's three big infectious diseases (AIDS, malaria and tuberculosis) and spreads globally.

Dengue virus is single-stranded RNA virus belonging to Flavivirus family and has four serotypes distinct in their antigenicity. It is perceived that once infection occurs with a certain serotype of dengue virus, reinfection of the same serotype of dengue virus will never occur for almost lifelong period due to acquired immunity. However, cross protection against different serotypes continues only for about 12 weeks at the longest and therefore dengue virus infection can occur twice or more. In particular, it is known that "dengue hemorrhagic fever" and "dengue shock syndrome", which are severe clinical conditions sometimes leading to death, likely occur at the second or later infections.

For dengue infection, there is no established therapy and its prevention is limited. Under existing conditions, countermeasures against infection are to expel mosquitos and to improve environments, and to guide for the use of repellent and appropriate clothes on a personal level. However, these measures are not sufficient in view of cost and effect. Therefore, prevention of infection or prevention of incidence by a vaccine is desired which can be inoculated in a wide age range and exhibits excellent efficacy.

PRIOR ART

Patent Reference

Patent reference 1: EP 1159968
Patent reference 2: Japanese patent 5197362
Patent reference 3: Japanese patent 5075120
Patent reference 4: WO 2007/141259
Patent reference 5: WO 2000/057910

Non-Patent Reference

Non-patent reference 1: Safety and immunogenicity of tetravalent live-attenuated dengue vaccines in Thai adult volunteers: role of serotype concentration, ratio, and multiple doses, Am. J. Trop MedImmune Hyg., 2002; 66(3):264-72.

Non-patent reference 2: Dengue vaccines: recent developments, ongoing challenges and current candidates, Expert Rev Vaccines, 2013; 12(8):933-53.

Non-patent reference 3: Efficacy of a tetravalent chimeric dengue vaccine (DENVax) in Cynomolgus macaque, Am J Trop Med Hyg., 2011; 84(6):978-87.

Non-patent reference 4: Recombinant, live-attenuated tetravalent dengue virus vaccine formulations induce a balanced, broad, and protective neutralizing antibody response against each of the four serotypes in rhesus monkeys, J Virol, 2005; 79(9):5516-28.

Non-patent reference 5: Evaluation of Interferences between Dengue Vaccine Serotypes in a Monkey Model, Am J Trop Med Hyg., 2009; 80(2):302-11.

Non-patent reference 6: Protection of Rhesus monkeys against dengue virus challenge after tetravalent live attenuated dengue virus vaccination, J Infect Dis., 2006; 193(12):1658-65.

DISCLOSURE OF THE INVENTION

Technical Problem to be Solved by the Invention

As stated above, there is a high risk that the second or later infections of serotypes different from that of the first infection make symptoms severer. Therefore, a tetravalent vaccine which simultaneously confers protection against all of the four serotypes of dengue virus is desired. However, in spite of efforts made to develop a vaccine for several ten years, there is no vaccine that shows excellent efficacy against all of the four serotypes of dengue virus.

A dengue virus genome codes for a structural protein such as C protein, M protein and E protein and for seven non-structural (NS) proteins which do not constitute a viral particle and act during replication. Thus, a genetically recombined, chimeric live vaccine with a backbone of another virus or a specific serotype of dengue virus, or an inactivated whole particle vaccine, a subunit vaccine, a DNA vaccine and the like lack components from dengue virus and present only a part of various immunological antigens generated within the living body by natural infection of dengue virus.

On the other hand, an attenuated live vaccine which acquired host cell mutation by passage and habituation in cells different from a natural host cell, may induce an immune reaction similar to that of natural infection, as proved in measles, rubella, mumps, polio, etc. and thus high efficacy may also be expected in dengue virus infection Dengue vaccines which are under development or are commercially available are capable of inducing neutralizing antibodies against all of the four serotypes of dengue virus by multiple administrations. However, it takes much time before neutralizing antibodies against all of the four serotypes are acquired during which there is a risk of natural infection in an endemic area. Therefore, a vaccine that may confer protective immunity to all of the four serotypes with single administration is more useful.

For preparing a dengue virus vaccine, it is not easy to select a mixed composition of strains and doses of the respective serotypes. There is a problem that, even if a high neutralizing antibody may be induced with monovalent administration, the levels of neutralizing antibodies against the respective serotypes of dengue virus do not become uniform with tetravalent administration (interferential action). Also, there is a problem of Antibody-Dependent Enhancement (ADE) due to antibodies with insufficient neutralizing activity (cross reaction, binding).

Three approved drugs or major development articles under clinical trial are ChimeriVax-DEN (Dengvaxia (trademark)) by Sanofi, DENVax (trademark) by Takeda and TetraVax (trademark) by Butantan, all of which are genetically recombined, chimeric live vaccines. Dengvaxia by Sanofi is a genetically recombined, chimeric live vaccine with a backbone of yellow fever strain YF-17D and is approved for subjects of 9 to 45 years old with three inoculations of six-month interval in three countries, Mexico, Brazil and the Philippines.

Phase 3 trial of Dengvaxia was performed for about 10,000 subjects of an age range of 2 to 15 years old in five countries of South-East Asia and about 20,000 subjects of an age range of 9 to 16 years old in five countries of South America. As a result, efficacy was found to be as low as around sixty percent. In particular, for serotype 2, efficacy was around forty percent and was not enough. Efficacy for subjects who had no prior immunity against dengue virus was around forty percent. Furthermore, in a long-term follow-up of phase 3 trial and in a long-term follow-up of phase 2b trial in Thailand, a risk for hospitalization at the third year was 1.6-fold higher than non-inoculation group in an age range of not more than 9 years old, and in particular, around 5-fold higher in an age range of 5 years old or less. This is considered problematic as being Vaccine Enhancement. The causes of such low efficacy are thought to be deficiency of dengue-derived components, variation of epidemic strains, and the like. Therefore, with a live vaccine with passage and habituation, which contains all of the dengue-derived components, is not subject to active cloning and contains quasispecies of the virus, higher efficacy is expected.

Means for Solving the Problems

The present inventors have earnestly studied so as to solve the above problems. As a result, the present inventors have found an attenuated tetravalent live dengue virus vaccine which was excellent in both efficacy and safety. Also, the present inventors have found an attenuated tetravalent live dengue virus vaccine which was excellent in both efficacy and safety both with single administration and with multiple administrations.

Attenuated strains are known that were obtained by passage of wild-type dengue viruses (serotypes 1 to 4) in Primary Dog Kidney (PDK) cells or Primary Green Monkey Kidney (PGMK) cells. The present invention further provides attenuated dengue viruses obtained by passage in African green monkey kidney (Vero) cells and an attenuated dengue virus vaccine comprising a bank of the live viruses as an antigen.

Thus, the present invention includes the followings.

[1] An attenuated serotype 1 dengue virus wherein said virus has homology of 95% or more with serotype 1 dengue virus parent strain 03135 having an amino acid sequence of SEQ ID NO: 1 as analyzed using a Next Generation Sequencer, has complete mutation at any one of amino acid residue at position 483, 568 or 1663 of said parent strain, and further has one or more mutations of the following (1) to (4):

(1) K482E or K482E/K (2) K484R or K484R/K (3) I/T2353T (4) A2364T or A2364T/A.

[2] The attenuated serotype 1 dengue virus of [1] wherein said virus has homology of 97% or more with the parent strain 03135 having an amino acid sequence shown by SEQ ID NO: 1.

[3] The attenuated serotype 1 dengue virus of [1] wherein said virus has homology of 99% or more with the parent strain 03135 having an amino acid sequence shown by SEQ ID NO: 1.

[4] The attenuated serotype 1 dengue virus of any one of [1] to [3] wherein said virus has complete mutation at amino acid residues at positions 483, 568 and 1663.

[5] The attenuated serotype 1 dengue virus of [4] wherein the mutation at position 483 is E483K.

[6] The attenuated serotype 1 dengue virus of [4] wherein the mutation at position 568 is K568R.

[7] The attenuated serotype 1 dengue virus of [4] wherein the mutation at position 1663 is N1663K.

[8] The attenuated serotype 1 dengue virus of [4] wherein the mutation at position 483 is E483K, the mutation at position 568 is K568R and the mutation at position 1663 is N1663K.

[9] The attenuated serotype 1 dengue virus of any one of [1] to [8] wherein said virus has all of the mutations of (1) to (4) as above.

[10] An attenuated serotype 2 dengue virus wherein said virus has homology of 95% or more with serotype 2 dengue virus parent strain 99345 having an amino acid sequence of SEQ ID NO: 2 as analyzed using a Next Generation Sequencer, has complete mutation at any one of amino acid residue at position 143, 400, 1102, 1308 or 1654 of said parent strain, and further has mutation of the following (5) or (6):

(5) P2347L or P2347P/L (6) T2828M or T2828T/M.

[11] The attenuated serotype 2 dengue virus of [10] wherein said virus has homology of 97% or more with the parent strain 99345 having an amino acid sequence shown by SEQ ID NO: 2.

[12] The attenuated serotype 2 dengue virus of [10] wherein said virus has homology of 99% or more with the parent strain 99345 having an amino acid sequence shown by SEQ ID NO: 2.

[13] The attenuated serotype 2 dengue virus of any one of [10] to [12] wherein said virus has complete mutation at amino acid residues at positions 143, 400, 1102, 1308 and 1654.

[14] The attenuated serotype 2 dengue virus of [13] wherein the mutation at position 143 is D143N.

[15] The attenuated serotype 2 dengue virus of [13] wherein the mutation at position 400 is T400K.

[16] The attenuated serotype 2 dengue virus of [13] wherein the mutation at position 1102 is D1102N.

[17] The attenuated serotype 2 dengue virus of [13] wherein the mutation at position 1308 is L1308F.

[18] The attenuated serotype 2 dengue virus of [13] wherein the mutation at position 1654 is E1654K.

[19] The attenuated serotype 2 dengue virus of [13] wherein the mutation at position 143 is D143N, the mutation at position 400 is T400K, the mutation at position 1102 is D1102N, the mutation at position 1308 is L1308F, and the mutation at position 1654 is E1654K.

[20] The attenuated serotype 2 dengue virus of any one of [10] to [19] wherein said virus has the mutations of (5) and (6) as above.

[21] An attenuated serotype 3 dengue virus wherein said virus has homology of 95% or more with serotype 3 dengue virus parent strain 16562 having an amino acid sequence of SEQ ID NO: 3 as analyzed using a Next Generation Sequencer, has complete mutation at any one of amino acid residue at position 209, 582, 1211 or 1563 of said parent strain, and further has one or more mutations of the following (7) to (10):

(7) K/R671K (8) A687V (9) T764I/T

(10) A1237T.

[22] The attenuated serotype 3 dengue virus of [21] wherein said virus has homology of 97% or more with the parent strain 16562 having an amino acid sequence shown by SEQ ID NO: 3.

[23] The attenuated serotype 3 dengue virus of [21] wherein said virus has homology of 99% or more with the parent strain 16562 having an amino acid sequence shown by SEQ ID NO: 3.

[24] The attenuated serotype 3 dengue virus of any one of [21] to [23] wherein said virus has complete mutation at amino acid residues at positions 209, 582, 1211, 1563 and 1654.

[25] The attenuated serotype 3 dengue virus of [24] wherein the mutation at position 209 is I209L.

[26] The attenuated serotype 3 dengue virus of [24] wherein the mutation at position 582 is S582G.

[27] The attenuated serotype 3 dengue virus of [24] wherein the mutation at position 1211 is F1211L.

[28] The attenuated serotype 3 dengue virus of [24] wherein the mutation at position 1563 is Q1563K.

[29] The attenuated serotype 3 dengue virus of [24] wherein the mutation at position 209 is I209L, the mutation at position 582 is S582G, the mutation at position 1211 is F1211L, and the mutation at position 1563 is Q1563K.

[30] The attenuated serotype 3 dengue virus of any one of [21] to [29] wherein said virus has all of the mutations of (7) to (10) as above.

[31] An attenuated serotype 4 dengue virus wherein said virus has homology of 95% or more with serotype 4 dengue virus parent strain 1036 having an amino acid sequence of SEQ ID NO: 4 as analyzed using a Next Generation Sequencer, has complete mutation at amino acid residue at position 2187 or 2354 of said parent strain, and further has no mutation at position 624, 742, 1628, 2286, 2482 or 2508.

[32] The attenuated serotype 4 dengue virus of [31] wherein said virus has homology of 97% or more with the parent strain 1036 having an amino acid sequence shown by SEQ ID NO: 4.

[33] The attenuated serotype 4 dengue virus of [31] wherein said virus has homology of 99% or more with the parent strain 1036 having an amino acid sequence shown by SEQ ID NO: 4.

[34] The attenuated serotype 4 dengue virus of any one of [31] to [33] wherein said virus has complete mutation at amino acid residues at positions 2187 and 2354.

[35] The attenuated serotype 4 dengue virus of [34] wherein the mutation at position 2187 is L2187F.

[36] The attenuated serotype 4 dengue virus of [34] wherein the mutation at position 2354 is F/L2354S.

[37] The attenuated serotype 4 dengue virus of [34] wherein the mutation at position 2187 is L2187F and the mutation at position 2354 is F/L2354S.

[38] The attenuated serotype 4 dengue virus of any one of [31] to [37] wherein said virus has no mutation at positions 624, 742, 1628, 2286, 2482 and 2508.

[39] An attenuated dengue virus vaccine comprising as an antigen one or more of attenuated dengue viruses selected from the group consisting of the attenuated serotype 1 dengue virus of any one of [1] to [9], the attenuated serotype 2 dengue virus of any one of [10] to [20], the attenuated serotype 3 dengue virus of any one of [21] to [30] and the attenuated serotype 4 dengue virus of any one of [31] to [38].

[40] An attenuated tetravalent dengue virus vaccine comprising as an antigen the attenuated serotype 1 dengue virus of any one of [1] to [9], the attenuated serotype 2 dengue virus of any one of [10] to [20], the attenuated serotype 3 dengue virus of any one of [21] to [30] and the attenuated serotype 4 dengue virus of any one of [31] to [38].

[41] The attenuated dengue virus vaccine of [39] or [40] wherein a mixing ratio of the attenuated serotype 1, 2, 3 and 4 dengue viruses is 1:1:1:1, 5:3:5:3, or 5:3:3:3.

[42] The attenuated dengue virus vaccine of any one of [39] to [41] wherein a respective antigenic amount of the attenuated serotype 1, 2, 3 and 4 dengue viruses is 1 to 7 log 10 FFU/dose.

[43] A process for preparing the attenuated serotype 1 dengue virus of any one of [1] to [9], which comprises subjecting serotype 1 dengue virus parent strain 03135 having an amino acid sequence of SEQ ID NO: 1 as analyzed using a Next Generation Sequencer to 15 to 25 passage cultures in primary dog kidney (PDK) cells to obtain an attenuated strain, and further subjecting said attenuated strain to passage culture in African green monkey kidney (Vero) cells.

[44] A process for preparing the attenuated serotype 1 dengue virus of any one of [1] to [9], which comprises subjecting serotype 1 dengue virus parent strain 03135 having an amino acid sequence of SEQ ID NO: 1 as analyzed using a Next Generation Sequencer to 15 passage cultures in PDK cells to obtain an attenuated strain, and further subjecting said attenuated strain to passage culture in Vero cells.

[45] A process for preparing the attenuated serotype 2 dengue virus of any one of [10] to [20], which comprises subjecting serotype 2 dengue virus parent strain 99345 having an amino acid sequence of SEQ ID NO: 2 as analyzed using a Next Generation Sequencer to 20 to 25 passage cultures in PDK cells to obtain an attenuated strain, and further subjecting said attenuated strain to passage culture in Vero cells.

[46] A process for preparing the attenuated serotype 2 dengue virus of any one of [10] to [20], which comprises subjecting serotype 2 dengue virus parent strain 99345 having an amino acid sequence of SEQ ID NO: 2 as analyzed using a Next Generation Sequencer to 25 passage cultures in PDK cells to obtain an attenuated strain, and further subjecting said attenuated strain to passage culture in Vero cells.

[47] A process for preparing the attenuated serotype 3 dengue virus of any one of [21] to [30], which comprises subjecting serotype 3 dengue virus parent strain 16562 having an amino acid sequence of SEQ ID NO: 3 as analyzed using a Next Generation Sequencer to 20 to 30 passage cultures in primary green monkey kidney (PGMK) cells and to 2 to 5 passage cultures in PDK cells to obtain an attenuated strain, and further subjecting said attenuated strain to passage culture in Vero cells.

[48] A process for preparing the attenuated serotype 3 dengue virus of any one of [21] to [30], which comprises subjecting serotype 3 dengue virus parent strain 16562 having an amino acid sequence of SEQ ID NO: 3 as analyzed using a Next Generation Sequencer to 30 passage cultures in PGMK cells and to 4 passage cultures in PDK cells to obtain an attenuated strain, and further subjecting said attenuated strain to passage culture in Vero cells.

[49] A process for preparing the attenuated serotype 4 dengue virus of any one of [31] to [38], which comprises subjecting serotype 4 dengue virus parent strain 1036 having an amino acid sequence of SEQ ID NO: 4 as analyzed using a Next Generation Sequencer to 35 to 45 passage cultures in PDK cells to obtain an attenuated strain, and further subjecting said attenuated strain to passage culture in Vero cells.

[50] A process for preparing the attenuated serotype 4 dengue virus of any one of [31] to [38], which comprises subjecting serotype 4 dengue virus parent strain 1036 having an amino acid sequence of SEQ ID NO: 4 as analyzed using a Next Generation Sequencer to 40 passage cultures in PDK cells to obtain an attenuated strain, and further subjecting said attenuated strain to passage culture in Vero cells.

Effects of the Invention

The present invention provides a dengue vaccine which is capable of inducing neutralizing antibody response against all of the four serotypes of dengue virus even with single administration and has a level of safety (tolerability) equivalent to that of the other attenuated live virus vaccines commercially available.

BEST MODE FOR CARRYING OUT THE INVENTION

Figure 1:
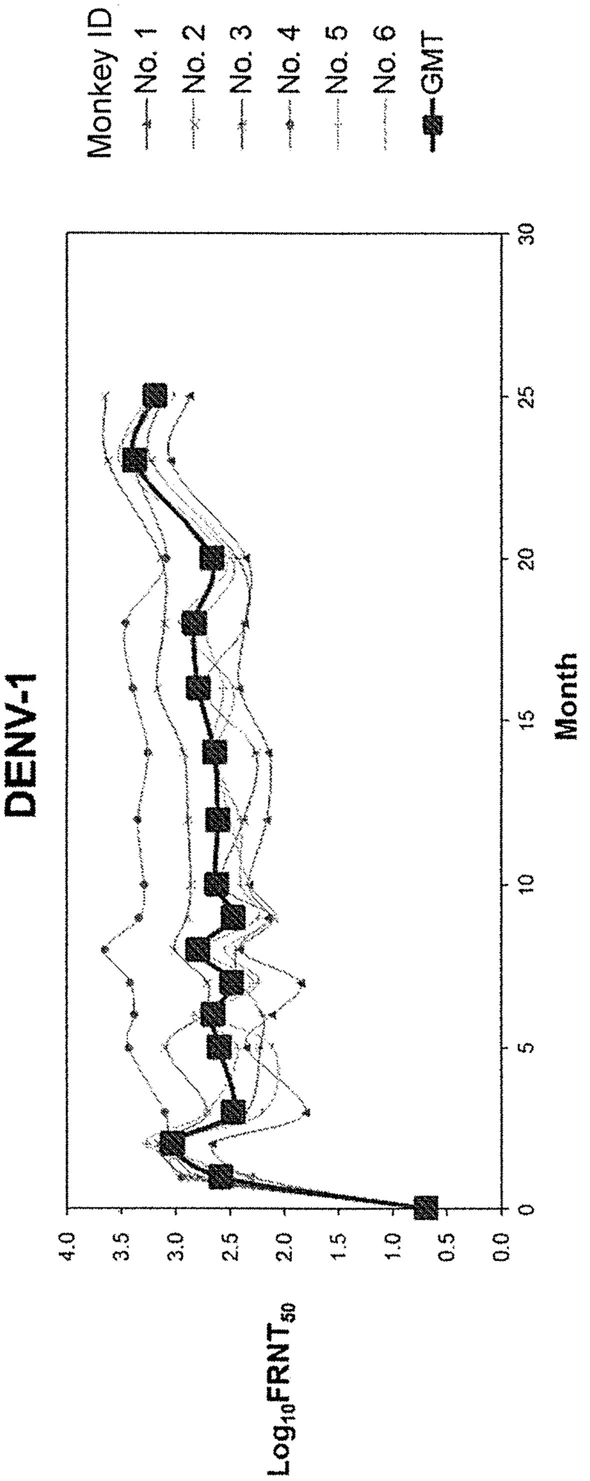
FIG. 1 shows long-term transition of neutralizing antibody titer (serotype 1).

In accordance with the present invention, a dengue vaccine is provided which is capable of inducing neutralizing antibody response against all of the four serotypes of dengue virus even with single administration and has a level of safety (tolerability) equivalent to that of the other attenuated live virus vaccines commercially available.

In the following, preferable embodiments of the present invention are explained in detail. It should be noted that the present invention is not limited to the following embodiments.

The present invention relates to an attenuated dengue virus which is prepared by subjecting clinically isolated wild-type dengue virus (parent strain) to passage culture in PDK cells or in PGMK cells and PDK cells to obtain an attenuated strain and further by subjecting said attenuated strain to passage culture in Vero cells. The attenuated dengue virus of the present invention includes a seed strain (VMS (Virus Master Seed), VWS (Virus Working Seed), etc.) used for a dengue vaccine and passage strain equivalent to products (bulk for testing GLP (Pre-CTM: Pre-Clinical Trial Material), etc.) as well as a dengue vaccine prepared using strains. In accordance with the present invention, by comparison and study of amino acid sequences of parent strain, attenuated strain, seed strain and passage strain equivalent to products, a position at which parent strain and attenuated strain can be distinguished and a position at which attenuated strain and seed strain, passage strain equivalent to products can be distinguished are specified.

The attenuated serotype 1 dengue virus of the present invention is obtained by subjecting clinically isolated parent strain 03135 (SEQ ID NO: 1) to 15 to 25 passage cultures in primary dog kidney (PDK) cells to obtain an attenuated strain 1, and further by subjecting said attenuated strain 1 to passage culture in Vero cells. The attenuated strain 1, as a result of passage culture, has complete mutation of either or all of glutamic acid at position 483, lysine at position 568 and asparagine at position 1663 to another amino acid, preferably mutations of E483K, K568R, N1663K, as compared to the parent strain 03135. The attenuated serotype 1 dengue virus of the present invention, in addition to the above mutations, further has one or more mutations at positions 482, 484, 2353, 2364, by passage culture in Vero cells, and can be genetically distinguished from the attenuated strain 1.

The attenuated serotype 2 dengue virus of the present invention is obtained by subjecting clinically isolated parent strain 99345 (SEQ ID NO: 2) to 20 to 35 passage cultures in PDK cells to obtain an attenuated strain 2, and further by subjecting said attenuated strain 2 to passage culture in Vero cells. The attenuated strain 2, as a result of passage culture, has complete mutation of either or all of aspartic acid at position 143, threonine at position 400, aspartic acid at position 1102, leucine at position 1308 and glutamic acid at position 1654 to another amino acid, preferably mutations of D143N, T400K, D1102N, L1308F, E1654K, as compared to the parent strain 99345. The attenuated serotype 2 dengue virus of the present invention further has mutation at position 2347 or 2828, by passage culture in Vero cells, and can be genetically distinguished from the attenuated strain 2.

The attenuated serotype 3 dengue virus of the present invention is obtained by subjecting clinically isolated parent strain 16562 (SEQ ID NO: 3) to 20 to 30 passage cultures in PGMK cells and further to 2 to 5 passage cultures in PDK cells to obtain an attenuated strain 3, and further by subjecting said attenuated strain 3 to passage culture in Vero cells. The attenuated strain 3 has complete mutation of either or all of isoleucine at position 209, serine at position 582, phenylalanine at position 1211 and glutamine at position 1563 to another amino acid, preferably mutations of I209L, S582G, F1211L, Q1563K, as compared to the parent strain 16562. The attenuated serotype 3 dengue virus of the present invention further has one or more mutations at positions 671, 687, 764, 1237, by passage culture in Vero cells, and can be genetically distinguished from the attenuated strain 3.

The attenuated serotype 4 dengue virus of the present invention is obtained by subjecting clinically isolated parent strain 1036 (SEQ ID NO: 4) to 35 to 45 passage cultures in PDK cells to obtain an attenuated strain 4, and further by subjecting said attenuated strain 4 to passage culture in Vero cells. The attenuated strain 4 has complete mutation of either or both of leucine at position 2187 and phenylalanine/leucine (mixed amino acids) at position 2354 to another amino acid, preferably mutations of L2187F, F/L2354S, as compared to the parent strain 1036. The attenuated serotype 4 dengue virus of the present invention further has no mutation at position 624, 742, 1628, 2286, 2482 or 2508 and can be genetically distinguished from the attenuated strain 4.

The present invention includes a vaccine comprising as an antigen the respective serotypes of dengue virus as described above. The vaccine of the present invention may be a monovalent vaccine comprising any one of serotypes 1 to 4 or a vaccine comprising a combination of any one of serotypes 1 to 4 or a tetravalent vaccine. In case of a tetravalent vaccine, a mixing ratio of serotypes 1, 2, 3 and 4 may be any but is preferably 1:1:1:1, 5:3:5:3, or 5:3:3:3. The dengue virus vaccine of the present invention may also be used as a priming vaccine in combination with another vaccine as a booster. The dengue virus vaccine of the present invention may also be used in admixture with another flavivirus virus vaccine or with a vaccine of another infectious disease.

A dosage form of a vaccine may suitably be selected and may be a liquid formulation, a powder formulation or a freeze-dried formulation.

The parent strains 16562 and 1036 are disclosed in Patent reference 1 and are deposited at CNCM (Collection Nationale de Cultures de Micro-organismes) of France as I-2482 and I-2483, respectively. For the parent strain 03135, its partial sequence is registered in GenBank as ADJ18295.1. For the parent strain 99345, its partial sequence is registered in GenBank as ADJ18294.1. The attenuated dengue viruses (serotypes 1 to 4) of the present invention have been deposited at ATCC (American Type Culture Collection; 10801 University Boulevard, Manassas, Va. 20110 USA) as deposit numbers PTA-123506, PTA-123505, PTA-123507 and PTA-123508, respectively.

In accordance with the present invention, a nucleotide sequence of dengue virus is analyzed using a Next Generation Sequencer. A Next Generation Sequencer is also called a second generation sequencer and for instance, in case of SBS sequencer of Illumina, allows for determination of nucleotide sequences of several millions or more of DNA fragments simultaneously in parallel. Its principle is basically similar to the conventional Sanger method using capillary electrophoresis. Fluorescence intensity while each one nucleotide is resynthesized with a DNA fragment as a template is detected to determine a nucleotide sequence. A Next Generation Sequencer is distinct from the Sanger method in that 1 to 96 DNA fragments are treated simultaneously in the latter whereas in the former a huge amount of several million or more DNA fragments are treated simultaneously in parallel by forming "cluster" corresponding to capillary in the Sanger method. This dramatically improved a speed of sequence analysis and allowed for research targeting a large genome region, research for low frequency mutation where a high read number is required, and research for quasispecies.

Nucleotide sequence analysis using a Next Generation Sequencer allows for research of quasispecies of viruses. Its big feature is that in case of mixing nucleotides, a mixing ratio of nucleotides can be obtained and quasispecies can also be determined. For notation, nucleotide sequences are herein converted to amino acid sequences. For instance, for notation of the amino acid residue at position 484 of the attenuated strain, it is shown that lysine is 30% and arginine is 70%.

As used herein, a site where mutation occurs when parent strains and attenuated strains etc. are compared to each other is indicated e.g. K482E, K482E/K etc. "K482E" denotes that lysine at position 482 is mutated to glutamic acid. "K482E/K" denotes that both mutations of lysine at position 482 to glutamic acid and to lysine are present.

A dengue virus genome codes for a structural protein such as C protein, M protein and E protein and seven non-structural (NS) proteins which do not constitute a viral particle but instead act during replication. Single polyprotein is translated from a dengue virus genome and then is processed into the respective structural proteins and non-structural proteins. For counting a position in an amino acid sequence, an initiation codon of a polyprotein is herein used as a starting point.

For the measurement with a Next Generation Sequencer, RNAs are first extracted from dengue virus, followed by reverse transcription with Random primer, formation of double strand, ligation of adaptor sequence and amplification to obtain aggregated data of short nucleotide sequences with SBS sequencer. From the data of the parent strain, the longest contig homologous to dengue virus are generated using assembler Velvet. A sequence on a gene bank which has high homology with said contig is aligned and supplemented with 5' terminal sequence and/or 3' terminal sequence for use as a reference sequence for resequencing analysis. For resequencing analysis, sequence data are mapped to the reference sequence using mapper BWA and virus genome sequences, including mixed nucleotides, are determined. From the obtained virus genome sequences, amino acid sequences, including mixed amino acids, are obtained. Mixed amino acids include only those present at 10% or more of a mixing ratio.

As a Next Generation Sequencer, MiSeq and HiSeq (both manufactured by Illumina) are known, but another model may also be used.

Attenuation property of dengue virus can be affirmed by, but not limited to, plaque size assay, growth temperature sensitivity test, animal test, and the like. For plaque size assay, using for instance LLC-MK2 cells from rhesus macaque, a diameter of plaques is measured and attenuation property is affirmed when the measured diameter is smaller than that of a parent strain. For growth temperature sensitivity test, using for instance Vero cells, culture temperature is changed and attenuation property is affirmed when growth potential is reduced at a higher temperature as compared to a parent strain.

Efficacy and safety test of dengue virus is conducted using NHP (Non-Human Primate) and some genetically recombined immunodeficiency mice. Representative NHP is cynomolgus monkey.

For measurement of neutralizing antibody titer, PRNT (Plaque Reduction Neutralizing Test) with an index of plaque, and Immunospot PRNT or FRNT (Focus Reduction Neutralization Titer) where virus-derived protein is labelled with antibody are used.

Measurement of a virus level in the blood is conducted by, but not limited to, direct use of plaque size assay or RT-qPCR (Real Time Quantitative Polymerase Chain Reaction) to indirectly detect virus genome fragments.

The present invention is explained in more detail with the following examples but is not limited thereto.

Example 1

(1) Preparation of Attenuated Strain

In Mahidol University in Thailand, attenuated dengue viruses (serotype 1, serotype 2, serotype 3 and serotype 4) for candidate of a novel vaccine were prepared in accordance with the following procedures. The attenuated serotype 1 dengue virus was prepared by subjecting clinically isolated strain 03135 as a parent strain to 15 passage cultures in primary dog kidney (PDK) cells. The attenuated serotype 2 dengue virus was prepared by subjecting clinically isolated strain 99345 as a parent strain to 25 passage cultures in PDK cells. The attenuated serotype 3 dengue virus was prepared by subjecting clinically isolated strain 16562 as a parent strain to 30 passage cultures in Primary Green Monkey Kidney (PGMK) cells and further to 4 passage cultures in PDK cells. The attenuated serotype 4 dengue virus was prepared by subjecting clinically isolated strain 1036 as a parent strain to 40 passage cultures in PDK cells. The attenuated serotype 1 dengue virus was further subjected to 3 passage cultures in Vero cells. These attenuated dengue viruses are referred to as attenuated strains 1 to 4, respectively.

(2) Preparation of PreVMS

For preparing VMS (Virus Master Seed), preVMS seeds were first prepared. The preVMS seeds were obtained by subjecting the attenuated strains 1 to 4 to 2, 3, 3 or 2 passage cultures in Vero cells, respectively. In the following, specific procedures for preparing preVMS seeds of the respective serotypes are described.

(i) Serotype 1 PreVMS seed (PreVMS1)

For the first passage culture, the attenuated strain 1 was inoculated at Multiplicity of Infection (MOI) of 0.001 and the virus was adsorbed to Vero cells at 37° C. under 5% $CO_2$ for 90 minutes. Thereafter, serum free medium was added followed by culture at 37° C. under 5% $CO_2$. Twelve days after culture, freezing and thawing were repeated twice together with the culture container. Then, centrifuge (1500 rpm, 5 minutes) was conducted to precipitate cells and cell debris to recover supernatant. After adding FBS (Fetal Bovine Serum) in an amount 20% to the supernatant as a stabilizing agent, pH was adjusted with sodium bicarbonate and the supernatant was stored at −60° C. or less. As a result of measurement with plaque assay, the infectivity titer was $1.6\times10^7$ PFU/mL.

For the second passage culture, the attenuated strains 1 after the first passage culture was inoculated at MOI of 0.001 and the virus was adsorbed to Vero cells at 37° C. under 5% $CO_2$ for 90 minutes. Thereafter, a serum free medium was added followed by culture at 37° C. under 5% $CO_2$. Nine days after culture, culture supernatant was recovered. After adding FBS at a final concentration of 20% as a stabilizing agent, pH was adjusted with sodium bicarbonate and the supernatant was temporarily cryopreserved. After thawing, the supernatant was subjected to aseptic filtration at 0.2 μm and stored at −60° C. or less. As a result of measurement with plaque assay, the infectivity titer of PreVMS1 was $5.1\times10^6$ PFU/mL.

(ii) Serotype 2 PreVMS Seed (PreVMS2)

For the first passage culture, the attenuated strains 2 was inoculated at MOI of 0.001 and the virus was adsorbed to Vero cells at 37° C. under 5% $CO_2$ for 90 minutes. Thereafter, MEM+2% medium was added followed by culture at 37° C. under 5% $CO_2$. Ten days after culture, freezing and thawing were repeated twice together with the culture container. Then, centrifuge (1500 rpm, 5 minutes) was conducted to precipitate cells and cell debris to recover supernatant. After adding FBS at a final concentration of 20% as a stabilizing agent, pH was adjusted with sodium bicarbonate and the supernatant was subjected to aseptic filtration at 0.2 μm and stored at −60° C. or less. As a result of measurement with plaque assay, the infectivity titer was $2.7\times10^5$ PFU/mL.

For the second passage culture, the attenuated strains 2 after the first passage culture was inoculated at MOI of 0.001 and the virus was adsorbed to Vero cells at 37° C. under 5% $CO_2$ for 90 minutes. Thereafter, MEM+2% medium was added followed by culture at 37° C. under 5% $CO_2$. Eleven days after culture, freezing and thawing were repeated twice together with the culture container. Then, centrifuge (1500 rpm, 5 minutes) was conducted to precipitate cells and cell debris to recover supernatant. After aseptic filtration at 0.2 μm, FBS was added at a final concentration of 20% as a stabilizing agent, pH was adjusted with sodium bicarbonate and then the supernatant was stored at −60° C. or less. As a result of measurement with plaque assay, the infectivity titer was $1.1\times10^4$ PFU/mL.

For the third passage culture, the attenuated strains 2 after the second passage culture was inoculated at MOI of 0.001 and the virus was adsorbed to Vero cells at 37° C. under 5% $CO_2$ for 90 minutes. Thereafter, MEM+2% medium was added followed by culture with airtight stopper at 37° C. Six days after culture, culture supernatant was recovered. Then, centrifuge (1500 rpm, 5 minutes) was conducted to precipitate cells and cell debris to recover supernatant. After aseptic filtration at 0.2 μm, FBS was added at a final concentration of 20% as a stabilizing agent, pH was adjusted with sodium bicarbonate and then the supernatant was stored at −60° C. or less. As a result of measurement with plaque assay, the infectivity titer of PreVMS2 was $7.1\times10^4$ PFU/mL.

(iii) Serotype 3 PreVMS Seed (PreVMS3)

For the first passage culture, the attenuated strains 3 was inoculated at MOI of 0.001 and the virus was adsorbed to Vero cells at 37° C. under 5% $CO_2$ for 90 minutes. Thereafter, serum free medium was added followed by culture at 37° C. under 5% $CO_2$. Ten days after culture, culture supernatant was recovered. After aseptic filtration at 0.2 μm, FBS was added at a final concentration of 20% as a stabilizing agent, pH was adjusted with sodium bicarbonate and then the supernatant was stored at −60° C. or less. As a result of measurement with plaque assay, the infectivity titer of PreVMS2 was $9.8\times10^4$ PFU/mL.

For the second passage culture, the attenuated strains 3 after the first passage culture was inoculated at MOI of 0.001 and the virus was adsorbed to Vero cells at 37° C. under 5% $CO_2$ for 90 minutes. Thereafter, serum free medium was added followed by culture at 37° C. under 5% $CO_2$. Seven days after culture, culture supernatant was recovered. Then, centrifuge (1500 rpm, 5 minutes) was conducted to precipitate cells and cell debris to recover supernatant. After aseptic filtration at 0.2 μm, FBS was added at a final concentration of 20% as a stabilizing agent, pH was adjusted with sodium bicarbonate and then the supernatant was stored at −60° C. or less. As a result of measurement with plaque assay, the infectivity titer was $1.3\times10^5$ PFU/mL.

For the third passage culture, the attenuated strains 3 after the second passage culture was inoculated at MOI of 0.001 and the virus was adsorbed to Vero cells at 37° C. under 5% $CO_2$ for 90 minutes. Thereafter, serum free medium was added followed by culture at 37° C. under 5% $CO_2$. Seven days after culture, culture supernatant was recovered. Then, centrifuge (1500 rpm, 5 minutes) was conducted to precipitate cells and cell debris to recover supernatant. After aseptic filtration at 0.2 μm, FBS was added at a final concentration of 20% as a stabilizing agent, pH was adjusted with sodium bicarbonate and then the supernatant was stored at −60° C. or less. As a result of measurement with plaque assay, the infectivity titer of PreVMS3 was $3.7\times10^5$ PFU/mL.

(iv) Serotype 4 PreVMS Seed (PreVMS4)

For the first passage culture, the attenuated strains 4 was inoculated at MOI of 0.001 and the virus was adsorbed to Vero cells at 37° C. under 5% $CO_2$ for 90 minutes. Thereafter, serum free medium was added followed by culture at 37° C. under 5% $CO_2$. Seven days after culture, culture supernatant was recovered. Then, centrifuge (1500 rpm, 5 minutes) was conducted to precipitate cells and cell debris to recover supernatant. After aseptic filtration at 0.2 μm, FBS was added at a final concentration of 20% as a stabilizing agent, pH was adjusted with sodium bicarbonate and then the supernatant was stored at −60° C. or less. As a result of measurement with plaque assay, the infectivity titer was $1.9\times10^7$ PFU/mL.

For the second passage culture, the attenuated strains 4 after the first passage culture was inoculated at MOI of 0.001 and the virus was adsorbed to Vero cells at 37° C. under 5% $CO_2$ for 90 minutes. Thereafter, serum free medium was added followed by culture at 37° C. under 5% $CO_2$. Five days after culture, culture supernatant was recovered. Then, centrifuge (2000 rpm, 5 minutes) was conducted to precipitate cells and cell debris to recover supernatant. After aseptic filtration at 0.2 μm, FBS was added at a final concentration of 20% as a stabilizing agent, pH was adjusted with sodium bicarbonate and then the supernatant was stored at −60° C. or less. As a result of measurement with plaque assay, the infectivity titer of PreVMS4 was $5.5\times10^7$ PFU/mL.

(3) Preparation of VMS

PreVMS was further subjected to 1 passage culture to prepare the most upstream of virus bank, VMS1, VMS2, VMS3 and VMS4. In the following, specific procedures for preparing VMS of the respective serotypes are described.

(i) VMS1

PreVMS1 was inoculated at MOI of 0.01 and the virus was adsorbed to Vero cells at 37° C. under 5% $CO_2$ for minutes. Thereafter, serum free medium was added followed by culture at 37° C. under 5% $CO_2$. Seven days after culture, freezing and thawing were repeated twice together with the culture container. Then, centrifuge (3000 rpm, 10 minutes) was conducted to precipitate cells and cell debris to recover supernatant. After adding FBS at a final concentration of 20% as a stabilizing agent and sodium bicarbonate at a final concentration of 0.2%, the supernatant was subjected to aseptic filtration at 0.2 μm and stored at −60° C. or less. As a result of measurement with plaque assay, the infectivity titer of VMS1 was $1.49\times10^6$ PFU/mL.

(ii) VMS2

PreVMS2 was inoculated at MOI of 0.001 and the virus was adsorbed to Vero cells at 37° C. under 5% $CO_2$ for minutes. Thereafter, serum free medium was added followed by culture at 37° C. under 5% $CO_2$. Eight days after culture, culture supernatant was recovered. Then, centrifuge (1800 rpm, 10 minutes) was conducted to precipitate cells and cell debris to recover supernatant, which was subjected to aseptic filtration at 0.2 μm. After adding FBS at 0.258-times amount relative to the supernatant as a stabilizing agent and sodium bicarbonate at 0.03445-times amount relative to the supernatant, the supernatant was stored at −60° C. or less. As a result of measurement with plaque assay, the infectivity titer of VMS2 was $2.07\times10^5$ PFU/mL.

(iii) VMS3

PreVMS3 was inoculated at MOI of 0.01 and the virus was adsorbed to Vero cells at 37° C. under 5% $CO_2$ for 90 minutes. Thereafter, serum free medium was added followed by culture at 37° C. under 5% $CO_2$. Six days after culture, culture supernatant was recovered. Then, centrifuge (3000 rpm, 10 minutes) was conducted to precipitate cells and cell debris to recover supernatant. After adding FBS at a final concentration of 20% as a stabilizing agent and sodium bicarbonate at a final concentration of 0.2%, the supernatant was subjected to aseptic filtration at 0.2 μm and stored at −60° C. or less. As a result of measurement with plaque assay, the infectivity titer of VMS3 was $6.49\times10^4$ PFU/mL.

(iv) VMS4

PreVMS4 was inoculated at MOI of 0.01 and the virus was adsorbed to Vero cells at 37° C. under 5% $CO_2$ for 90 minutes. Thereafter, serum free medium was added followed by culture at 37° C. under 5% $CO_2$. Six days after culture, culture supernatant was recovered. Then, centrifuge (3000 rpm, 10 minutes) was conducted to precipitate cells and cell debris to recover supernatant. After adding FBS at a final concentration of 20% as a stabilizing agent and sodium bicarbonate at a final concentration of 0.2%, the supernatant was subjected to aseptic filtration at 0.2 μm and stored at −60° C. or less. As a result of measurement with plaque assay, the infectivity titer of VMS4 was $9.39\times10^6$ PFU/mL.

(4) Preparation of Pre-CTM

Next, bulk for testing GLP (hereinafter referred to as "Pre-CTM"; Pre-Clinical Trial Material) was prepared. For serotype 1, VMS1 was subjected to 4 passage cultures in Vero cells to obtain Pre-CTM1. For serotypes 2 to 4, VMS2 to 4 were subjected to 2 passage cultures in Vero cells to prepare Virus Working Seed (VWS). VWS2 to 4 were further subjected to 2 passage cultures (4 passage cultures in total counting from VMS) to obtain Pre-CTM2 to 4. From VMS to the third passage culture, after culture supernatant was centrifuged, FBS at a final concentration of 20% as a stabilizing agent was added and sodium bicarbonate at a final concentration of 0.2% was added. The supernatant was subjected to aseptic filtration at 0.2 μm and then stored at −60° C. or less. For the fourth passage culture, which was the last passage culture, sodium bicarbonate at a final concentration of 0.2% was added to the culture supernatant. After clarifying filtration and aseptic filtration at 0.2 μm, the culture supernatant was concentrated with a hollow fiber membrane. The concentrate was subjected to aseptic filtration at 0.2 μm and then stored at −60° C. or less. In this working example, VWS1 was not prepared but instead Pre-CTM1 was prepared. However, VMS1 may be subjected to 2 passage cultures in Vero cells to prepare VWS1 and the obtained VWS1 may be subjected to 2 passage cultures in Vero cells to prepare Pre-CTM1.

(5) Sequencing

Virus genome sequences were investigated as described below. RNAs were extracted from each of parent strain, attenuated strain, VMS and Pre-CTM of the respective serotypes, followed by reverse transcription with Random primer, formation of double strand, addition of adaptor sequence and amplification to obtain aggregated data of short sequences with SBS sequencer (Illumina). From the data of the parent strain, contigs were prepared using assembler Velvet to obtain the longest contig homologous to dengue virus. A sequence on a gene bank which had high homology with said contig was aligned and supplemented with 5' terminal sequence and/or 3' terminal sequence for use as a reference sequence for resequencing analysis. For resequencing analysis, sequence data were mapped to the reference sequence using mapper BWA and virus genome sequences, including mixed nucleotides, were determined (SEQ ID NOs: 17 to 20, 21 to 24, 25 to 28, and 29 to 32 show the nucleotide sequences of the parent strains 1 to 4, the attenuated strains 1 to 4, VMS1 to 4, and Pre-CTM1 to 4, respectively). From the obtained virus genome sequences, amino acid sequences, including mixed amino acids, were obtained (SEQ ID NOs: 1 to 4, 5 to 8, 9 to 12, and 13 to 16 show the amino acid sequences of the parent strains 1 to 4, the attenuated strains 1 to 4, VMS1 to 4, and Pre-CTM1 to 4, respectively). Mixed amino acids included only those present at 10% or more of a mixing ratio. For the comparison of amino acid sequences, a threshold was that a mixing ratio of the respective amino acid residues at a position was different from each other by 10% or more to determine difference between the amino acid sequences. For instance, when the results are obtained that the amino acid residues at position 50 of the parent strain are “alanine 95%, glycine 5%” and the amino acid residues at position 50 of the attenuated strain are “alanine 85%, glycine 14%, proline 1%”, the indication of the amino acid of the parent strain is A (alanine alone) while the indication of the amino acid of the attenuated strain is A/G (a mixture of amino acids alanine and glycine). In this position, comparing the mixing ratios of alanine between the parent strain and the attenuated strain, they are different from each other by 10% or more (10%) to determine that “there is difference” between the parent strain and the attenuated strain. Although only 9% difference is seen for glycine, it is determined that “there is difference” when difference is seen for at least one amino acid residue. On the other hand, when the amino acid residues at position 100 of the parent strain are “alanine 94%, glycine 6%” and the amino acid residues at position 100 of the attenuated strain are “alanine 85%, glycine 15%”, the indication of the amino acid of the parent strain is also A (alanine alone) while the indication of the amino acid of the attenuated strain is also A/G. However, comparing the mixing ratios of alanine and glycine between the parent strain and the attenuated strain, they are both different from each other by less than 10% (9%) to determine that “there is no difference” between the parent strain and the attenuated strain.

(6) Comparison of Amino Acid Sequences

The sequences of the parent strains and the attenuated strains were compared to each other to identify positions where complete mutation of amino acid occurred (Tables 1 to 4). For positions of the parent strains where mixed amino acids occur, mutation at the corresponding position of the attenuated strains to other amino acid than the mixed amino acids was regarded as complete mutation.

TABLE 1

| Serotype 1 | | |
|---|---|---|
| Position | Parent strain | Attenuated strain |
| 483 | E | K |
| 568 | K | R |
| 1663 | N | K |

TABLE 2

| Serotype 2 | | |
|---|---|---|
| Position | Parent strain | Attenuated strain |
| 143 | D | N |
| 400 | T | K |
| 1102 | D | N |
| 1308 | L | F |
| 1654 | E | K |
| 2351 | I | T |

TABLE 3

| Serotype 3 | | |
|---|---|---|
| Position | Parent strain | Attenuated strain |
| 209 | I | L |
| 582 | S | G |
| 607 | E | K |
| 1211 | F | L |
| 1563 | Q | K |

TABLE 4

| Serotype 4 | | |
|---|---|---|
| Position | Parent strain | Attenuated strain |
| 624 | E | K |
| 2187 | L | F |
| 2354 | F/L | S |

Next, the sequences of the attenuated strains, VMS and Pre-CTM were compared to each other to identify positions with which VMS and Pre-CTM can distinguished from the attenuated strains (Tables 5 to 8).

TABLE 5

| Serotype 1 | | | | |
|---|---|---|---|---|
| Position | Parent strain | Attenuated strain | VMS | Pre-CTM |
| 482 | K | K | E/K | E/K |
| 483 | E | K | K | K |
| 484 | K | K | R/K | R/K |
| 568 | K | R | R | R |
| 899 | I | I/M | I | I |
| 1663 | N | K | K | K |
| 2353 | T/I | T/I | T | T |
| 2364 | A | A | T/A | T/A |

TABLE 6

| Serotype 2 | | | | |
|---|---|---|---|---|
| Position | Parent strain | Attenuated strain | VMS | Pre-CTM |
| 143 | D | N | N | N |
| 400 | T | K | K | K |
| 1102 | D | N | N | N |
| 1308 | L | F | F | F |
| 1371 | I | I/V | I | I |
| 1654 | E | K | K | K |
| 2347 | P | P | P/L | P/L |
| 2351 | I | T | T | T/I |
| 2828 | T | T | T/M | T/M |

TABLE 7

| Serotype 3 | | | | |
|---|---|---|---|---|
| Position | Parent strain | Attenuated strain | VMS | Pre-CTM |
| 209 | I | L | L | L |
| 582 | S | G | G | G |
| 607 | E | K | E | E |
| 671 | K/R | R | K | K |

TABLE 7-continued

| Serotype 3 | | | | |
|---|---|---|---|---|
| Position | Parent strain | Attenuated strain | VMS | Pre-CTM |
| 687 | A | A | V | V |
| 764 | T | T | I/T | I/T |
| 1211 | F | L | L | L |
| 1237 | A | A | T | T |
| 1563 | Q | K | K | K |

TABLE 8

| Serotype 4 | | | | |
|---|---|---|---|---|
| Position | Parent strain | Attenuated strain | VMS | Pre-CTM |
| 624 | E | K | E | E |
| 742 | V | V/M | V | V |
| 1027 | Q | H/Q | H | H |
| 1628 | V | V/L | V | V |
| 2187 | L | F | F | F |
| 2286 | I | I/F | I | I |
| 2354 | F/L | S | S | S |
| 2482 | V | V/A | V | V |
| 2508 | D | D/Y | D | D |

It was affirmed that VMS and Pre-CTM of serotype 1 had complete mutations of from glutamic acid to lysine at position 483, from lysine to arginine at position 568, and from asparagine to lysine at position 1663, as compared to the parent strain 03135, which were the same mutations in these positions as those of the attenuated strain. It was also affirmed that VMS and Pre-CTM of serotype 1 had mutations of from lysine to mixed amino acids of glutamic acid/lysine at position 482, from lysine to mixed amino acids of arginine/lysine at position 484, from mixed amino acids of isoleucine/threonine to threonine at position 2353, and from alanine to mixed amino acids of threonine/alanine at position 2364, as compared to the parent strain 03135, which were different mutations in these positions from those of the attenuated strain.

It was affirmed that VMS and Pre-CTM of serotype 2 had complete mutations of from aspartic acid to asparagine at position 143, from threonine to lysine at position 400, from aspartic acid to asparagine at position 1102, from leucine to phenylalanine at position 1308, and from glutamic acid to lysine at position 1654, as compared to the parent strain 99345, which were the same mutations in these positions as those of the attenuated strain. It was also affirmed that VMS and Pre-CTM of serotype 2 had mutations of from proline to mixed amino acids of proline/leucine at position 2347, and from threonine to mixed amino acids of threonine/methionine at position 2828, as compared to the parent strain 99345, which were different mutations in these positions from those of the attenuated strain.

It was affirmed that VMS and Pre-CTM of serotype 3 had complete mutations of from isoleucine to leucine at position 209, from serine to glycine at position 582, from phenylalanine to leucine at position 1211, and from glutamine to lysine at position 1563, as compared to the parent strain 16562, which were the same mutations in these positions as those of the attenuated strain. It was also affirmed that VMS and Pre-CTM of serotype 3 had mutations of from mixed amino acids of lysine/arginine to lysine at position 671, from alanine to valine at position 687, from threonine to mixed amino acids of isoleucine/threonine at position 764, and from alanine to threonine at position 1237, as compared to the parent strain 16562, which were different mutations in these positions from those of the attenuated strain.

It was affirmed that VMS and Pre-CTM of serotype 4 had complete mutations of from leucine to phenylalanine at position 2187, and from mixed amino acids of phenylalanine/leucine to serine at position 2354, as compared to the parent strain 1036, which were the same mutations in these positions as those of the attenuated strain. It was also affirmed that VMS and Pre-CTM of serotype 4 had no mutation at positions 624, 742, 1628, 2286, 2482 and 2508, as compared to the parent strain 1036, which were different in these positions from those of the attenuated strain.

(7) In Vitro Attenuation Property of VMS

In order to affirm in vitro attenuation property of VMS, plaque size assay was conducted using LLC-MK2 cells. A diameter of plaques was measured and divided into each segment as shown in Table 9.

TABLE 9

| Criteria for segmentation of plaque size | | | | |
|---|---|---|---|---|
| Segment | PP | S | M | L |
| Diameter (mm) | <1 | ≥1, <2 | ≥2, <4 | ≥4 |

As a result, distribution of plaque size of VMS1, VMS2, VMS3 and VMS4 was smaller than that of the parent strain to affirm their attenuation property (Table 10).

TABLE 10

| Results of plaque assay | | | | |
|---|---|---|---|---|
| Serotype | 1 | 2 | 3 | 4 |
| VMS | S 19%, PP 81% | PP 100% | PP 8%, S 92% | M 1%, S 85%, PP 14% |
| Parent strain | M 38%, S 62% | S 64%, PP 36% | S 94%, M 6% | M 31%, S 69% |

(8) Growth Temperature Sensitivity Test of VMS

VMS1, VMS2, VMS3 and VMS4 were cultured in Vero cells for a given days at 35° C. and 39° C. for VMS1, VMS2 and VMS4 and at 35° C. and 38° C. for VMS3 to determine growth difference between cultures at the low temperature and at the high temperature. As a result, as compared to the respective parent strains, all of VMS1, VMS2, VMS3 and VMS4 showed high growth temperature sensitivity to affirm their attenuation property (Table 11).

TABLE 11

| Results of growth temperature sensitivity test | | | | |
|---|---|---|---|---|
| Serotype | 1 | 2 | 3 | 4 |
| VMS | −1.8 Log10 | −2.5 Log10 | Not grow at high temperature | −2.4 Log10 |
| Parent strain | −0.2 Log10 | −1.6 Log10 | −1.9 Log10 | −1.7 Log10 |

Example 2

1. Efficacy and Safety Test of Tetravalent Dengue Virus Formulation Using Cynomolgus Monkey (1)

A test animal for dengue virus sensitivity is limited to NHP (Non-Human Primate) and some genetically recombined immunodeficiency mice. Therefore, evaluation of efficacy (neutralizing antibody response) and safety (viremia) was conducted using cynomolgus monkey, which is NHP. A neutralizing antibody response is one of the main evaluation items for vaccine development. Viremia is one of elements causing pathogenicity and severity of symptoms.

(1) Preparation of Tetravalent Dengue Virus Formulation (Formulation 5555)

For observing a response approximate to that of actual administration of vaccine, VMS1, VMS2, VMS3 and VMS4 were subjected to 4 passage cultures (VMSVP1, VMSVP2, VMSVP3 and VMSVP4) to prepare a tetravalent dengue virus formulation so that a dose of the respective VMSVP was 5 log 10 PFU/mL, 1.0 mL/dose (Formulation 5555). The Formulation 5555 was administered subcutaneously to three cynomolgus monkeys at the forearm under anesthesia (Group 5555). The date of administration was set to Day 0 and blood sampling was conducted at Days 0, 1, 2, 3, 4, 6, 8, 10, 14, 30 and 60 under anesthesia.

(2) Measurement of Neutralizing Antibody Titer by Immunospot PRNT

A neutralizing antibody titer in sera obtained by blood sampling at Days 0, 14, 30 and 60 was measured by Immunospot PRNT (Plaque Reduction Neutralizing Test). As a result, for all of the three animals and for all of the four serotypes, positive conversion of neutralizing antibody was observed at Day 14 and thereafter and the positivity was maintained at least up till Day 60 (criteria of positive conversion was 10PRNT50 or more; Table 12 and Table 13).

(3) Measurement of Genome Level in Blood by RT-qPCR

A virus genome level in sera obtained by blood sampling at Days 1, 2, 3, 4, 6, 8, 10 and 14 was measured by RT-qPCR (Real Time Quantitative Polymerase Chain Reaction) to reveal a genome level less than quantification limits for all of the three animals (quantification limits: 500 for serotype 1, 1000 for serotypes 2, 3 and 4; unit was genome copy/mL serum).

The results shown above affirmed good efficacy and safety.

Example 3

1. Efficacy and Safety Test of Tetravalent Dengue Virus Formulation Using Cynomolgus Monkey (2)

For affirming effect of tetravalent dengue virus formulations with different dose (mixed dose) of the respective serotypes on efficacy and safety, the following experiments were conducted.

(1) Preparation of Tetravalent Dengue Virus Formulations (Formulation 5353 and Formulation 5333)

A formulation with a content of VMSVP1, VMSVP2, VMSVP3 and VMSVP4 at 5 log 10 PFU/dose, 3 log 10 PFU/dose, 5 log 10 PFU/dose and 3 log 10 PFU/dose, respectively (Formulation 5353) and a formulation with a content of VMSVP1 at 5 log 10 PFU/dose, and a content of VMSVP2, VMSVP3 and VMSVP4 at 3 log 10 PFU/dose (Formulation 5333) were prepared. Neutralizing antibody

TABLE 12

Neutralizing antibody titer of Group 5555 (Day 0, Day 14)

| | | Days after administration | | | | | | | |
|---|---|---|---|---|---|---|---|---|---|
| | | Day 0 | | | | Day 14 | | | |
| | | Serotype | | | | | | | |
| | | 1 | 2 | 3 | 4 | 1 | 2 | 3 | 4 |
| ID | 5041 | <10 | <10 | <10 | <10 | 1092 | 280 | 27 | 544 |
| | 5061 | <10 | <10 | <10 | <10 | 2433 | 71 | 92 | 932 |
| | 5072 | <10 | <10 | <10 | <10 | 420 | 305 | 70 | 335 |
| Geometric Mean | | <10 | <10 | <10 | <10 | 1037.2 | 182.3 | 55.8 | 553.8 |
| Geometric Mean ($Log_{10}$) | | 0.699 | 0.699 | 0.699 | 0.699 | 3.016 | 2.261 | 1.747 | 2.743 |
| S.D. ($Log_{10}$) | | 0 | 0 | 0 | 0 | 0.382 | 0.355 | 0.28 | 0.222 |

TABLE 13

Neutralizing antibody titer of Group 5555 (Day 30, Day 60)

| | | Days after administration | | | | | | | |
|---|---|---|---|---|---|---|---|---|---|
| | | Day 30 | | | | Day 60 | | | |
| | | Serotype | | | | | | | |
| | | 1 | 2 | 3 | 4 | 1 | 2 | 3 | 4 |
| ID | 5041 | 2938 | 9449 | 403 | 1131 | 1593 | 1398 | 471 | 1586 |
| | 5061 | 3190 | 1358 | 389 | 1728 | 2583 | 151 | 924 | 1702 |
| | 5072 | 5048 | 5594 | 86 | 618 | 4678 | 122 | 218 | 355 |
| Geometric Mean | | 3616.8 | 4155.9 | 238 | 1065 | 2680 | 295.3 | 456.1 | 985.9 |
| Geometric Mean ($Log_{10}$) | | 3.558 | 3.619 | 2.377 | 3.027 | 3.428 | 2.47 | 2.659 | 2.994 |
| S.D. ($Log_{10}$) | | 0.127 | 0.436 | 0.383 | 0.224 | 0.234 | 0.587 | 0.314 | 0.384 |

response and viremia were evaluated using three cynomolgus monkeys (Group 5353 and Group 5333, respectively).

(2) Measurement of Neutralizing Antibody Titer by Immunospot PRNT

For neutralizing antibody response, positive conversion of neutralizing antibody was observed at Day 14 and thereafter for both Group 5353 and Group 5333, excepting that one animal of Group 5353 did not have positive conversion at Day 14, and the positivity was maintained up till Day 60 (Tables 6 to 9). The one animal of Group 5353 which did not have positive conversion at Day 14 had positive conversion at Day 30 and thereafter and the positivity was maintained up till Day 60 (Tables 14 to 17).

TABLE 14

Neutralizing antibody titer of Group 5353 (Day 0, Day 14)

| | Days after administration | | | | | | | |
|---|---|---|---|---|---|---|---|---|
| | Day 0 | | | | Day 14 | | | |
| | Serotype | | | | | | | |
| | 1 | 2 | 3 | 4 | 1 | 2 | 3 | 4 |
| ID 5039 | <10 | <10 | <10 | <10 | 1534 | 30 | 511 | <10 |
| 5067 | <10 | <10 | <10 | <10 | 2433 | 29 | 432 | 153 |
| 5049 | <10 | <10 | <10 | <10 | 2029 | 223 | 2366 | 62 |
| Geometric Mean | <10 | <10 | <10 | <10 | 1963.7 | 57.9 | 805.3 | 36.2 |
| Geometric Mean ($Log_{10}$) | 0.699 | 0.699 | 0.699 | 0.699 | 3.293 | 1.763 | 2.906 | 1.559 |
| S.D. ($Log_{10}$) | 0 | 0 | 0 | 0 | 0.101 | 0.507 | 0.407 | 0.77 |

TABLE 15

Neutralizing antibody titer of Group 5353 (Day 30, Day 60)

| | Days after administration | | | | | | | |
|---|---|---|---|---|---|---|---|---|
| | Day 30 | | | | Day 60 | | | |
| | Serotype | | | | | | | |
| | 1 | 2 | 3 | 4 | 1 | 2 | 3 | 4 |
| ID 5039 | 5693 | 1920 | 1728 | 1188 | 8600 | 301 | 2304 | 886 |
| 5067 | 8178 | 2304 | 379 | 1148 | 2012 | 189 | 506 | 471 |
| 5049 | 3776 | 806 | 1425 | 628 | 4686 | 169 | 501 | 612 |
| Geometric Mean | 5602 | 1527.7 | 977.2 | 949.7 | 4328.2 | 212.6 | 835.9 | 634.5 |
| Geometric Mean ($Log_{10}$) | 3.748 | 3.184 | 2.99 | 2.978 | 3.636 | 2.328 | 2.922 | 2.802 |
| S.D. ($Log_{10}$) | 0.168 | 0.244 | 0.359 | 0.156 | 0.317 | 0.133 | 0.381 | 0.138 |

TABLE 16

Neutralizing antibody titer of Group 5333 (Day 0, Day 14)

| | Days after administration | | | | | | | |
|---|---|---|---|---|---|---|---|---|
| | Day 0 | | | | Day 14 | | | |
| | Serotype | | | | | | | |
| | 1 | 2 | 3 | 4 | 1 | 2 | 3 | 4 |
| ID 5045 | <10 | <10 | <10 | <10 | ≥10240 | 154 | 888 | 37 |
| 5062 | <10 | <10 | <10 | <10 | 6507 | 400 | 27 | 51 |
| 5050 | <10 | <10 | <10 | <10 | 6080 | 283 | 147 | 159 |
| Geometric Mean | <10 | <10 | <10 | <10 | 7399.4 | 259.3 | 152.2 | 66.9 |
| Geometric Mean ($Log_{10}$) | 0.699 | 0.699 | 0.699 | 0.699 | 3.869 | 2.414 | 2.182 | 1.826 |
| S.D. ($Log_{10}$) | 0 | 0 | 0 | 0 | 0.123 | 0.21 | 0.759 | 0.333 |

TABLE 17

| Neutralizing antibody titer of Group 5333 (Day 30, Day 60) | | | | | | | | | |
|---|---|---|---|---|---|---|---|---|---|
| | | Days after administration | | | | | | | |
| | | Day 30 | | | | Day 60 | | | |
| | | Serotype | | | | | | | |
| | | 1 | 2 | 3 | 4 | 1 | 2 | 3 | 4 |
| ID | 5045 | 2502 | 7943 | 116 | 590 | 5495 | 386 | 581 | 559 |
| | 5062 | 2468 | 8059 | 117 | 4554 | 3639 | 744 | 143 | 604 |
| | 5050 | 2495 | 2031 | 160 | 613 | 6566 | 827 | 684 | 1298 |
| Geometric Mean | | 2488.3 | 5065.9 | 129.5 | 1181 | 5082.6 | 619.3 | 384.5 | 759.6 |
| Geometric Mean ($Log_{10}$) | | 3.396 | 3.705 | 2.112 | 3.072 | 3.706 | 2.792 | 2.585 | 2.881 |
| S.D. ($Log_{10}$) | | 0.003 | 0.344 | 0.08 | 0.508 | 0.131 | 0.179 | 0.374 | 0.202 |

(3) Measurement of Genome Level in Blood by RT-qPCR

A virus genome at a level of slightly exceeding quantification limits was detected from only one animal of Group 5333 at Day 4 for serotype 1 and serotype 4 (1632 and 2808 genome/mL, respectively). However, a genome level of the other animals of Group 5333 and Group 5353 was less than quantification limits. The virus genome level of the animal detected at Day 4 was low as compared to a geometric average of peak virus level per animals (75001 (21864 to 592650) and 9853 (3006 to 32315) genome/mL, respectively, N=3) when an equivalent amount of the parent strain of serotype 1 and the parent strain of serotype 4 were administered with monovalent inoculation.

The above results showed efficacy and safety of the Formulation 5353 and the Formulation 5333 equivalent to that of the Formulation 5555 to affirm that difference in viral dose of the respective serotypes in the formulation does not significantly affect on efficacy and safety.

Example 4

For evaluating formulations comprising dengue virus from attenuated dengue virus different from those of the Formulation 5555, the Formulation 5353 and the Formulation 5333, the following experiments were conducted.

(1) Preparation of Attenuated Strains 2B and 4B

Similar to Example 1(1) "Preparation of attenuated strain", the attenuated serotype 2 dengue virus was prepared by subjecting clinically isolated strain 99345 as a parent strain to 35 passage cultures in PDK cells and was referred to as attenuated strain 2B. Also, the attenuated serotype 4 dengue virus was prepared by subjecting clinically isolated strain 1036 as a parent strain to 45 passage cultures in PDK cells and was referred to as attenuated strain 4B.

(2) Preparation of LAVVP2B and LAVVP4B

The attenuated strains 2B and 4B were subjected to passage culture in Vero cells to obtain LAVVP2B (Live Attenuated Virus Vero Passaged 2B) and LAVVP4B, respectively.

(3) Preparation of VMSVP123LAVVP4 and VMSVP13LAVVP24

A tetravalent dengue virus formulation comprising VMSVP1, VMSVP2, VMSVP3 and LAVVP4B (each 5 log 10 PFU/dose; referred to as "VMSVP123LAVVP4") and a tetravalent dengue virus formulation comprising VMSVP1, LAVVP2B, VMSVP3 and LAVVP4B (each 5 log 10 PFU/dose; referred to as "VMSVP13LAVVP24") were prepared and evaluated for neutralizing antibody response and viremia using three cynomolgus monkeys (Group VMSVP123LAVVP4 and Group VMSVP13LAVVP24, respectively).

(4) Measurement of Neutralizing Antibody Titer by PRNT

By PRNT, neutralizing antibody titer of Group VMSVP123LAVVP4 and Group VMSVP13LAVVP24 was measured. As a result, both formulations induced neutralizing antibody response equivalent to that of the Formulation 5555 (Tables 18 and 19).

TABLE 18

| Neutralizing antibody titer of Group VMSVP123LAVVP4 and Group VMSVP13LAVVP24 (GMT, N = 3) (Day 0, Day 14) | | | | | | | | |
|---|---|---|---|---|---|---|---|---|
| | Days after administration | | | | | | | |
| | Day 0 | | | | Day 14 | | | |
| | Serotype | | | | | | | |
| | 1 | 2 | 3 | 4 | 1 | 2 | 3 | 4 |
| VMS123LAVVP4 | 0.699 | 0.699 | 0.932 | 0.699 | 3.772 | 3.302 | 3.232 | 3.813 |
| VMS13LAVVP24 | 0.699 | 0.699 | 0.699 | 0.699 | 3.457 | 2.677 | 2.641 | 3.477 |

TABLE 19

Neutralizing antibody titer of Group VMSVP123LAVVP4 and Group VMSVP13LAVVP24 (GMT, N = 3) (Day 30, Day 60)

| | Days after administration | | | | | | | |
|---|---|---|---|---|---|---|---|---|
| | Day 30 | | | | Day 60 | | | |
| | Serotype | | | | | | | |
| | 1 | 2 | 3 | 4 | 1 | 2 | 3 | 4 |
| VMS123LAVVP4 | 5583.8 | 9177.2 | 781.1 | 2262.4 | 5973.6 | 1129 | 647.8 | 1661.4 |
| VMS13LAVVP24 | 4821.1 | 2548.7 | 800.9 | 1903.7 | 2750.9 | 561.5 | 421.1 | 1320.5 |

(5) Measurement of Genome Level in Blood by RT-qPCR

For viremia, a comparatively high level of virus genome of serotype 4 was detected from Group VMSVP123LAVVP4 at Day 1 (10066 genome/mL, GMT, N=3) and a comparatively high level of virus genome of serotype 4 and a level of slightly exceeding quantification limits of virus genome of serotypes 1 and 2 were detected from Group VMSVP13LAVVP24 at Day 1 (12340, 547 and 1337 genome/mL, GMT, N=3, respectively), suggesting that VMSVP was highly attenuated as compared to LAVVP.

Interestingly, virus genome of serotype 1, though slightly, was detected from the two animals of Group VMSVP13LAVVP24 at Day 1 to suggest a good combination of VMSVP in tetravalent dengue virus formulations.

Example 5

(1) Long-Term Observation Test of Neutralizing Antibody Titer of Tetravalent Dengue Virus Formulation (Formulation 5555)

For conducting long-term evaluation of neutralizing antibody titer of the tetravalent dengue virus formulation (Formulation 5555), prepared using VMSVP1, VMSVP2, VMSVP3 and VMSVP4, which showed good efficacy and safety, six in total of cynomolgus monkeys (ID No. 1 to 6) received single inoculation of the Formulation 5555. The month of inoculation was set to Month 0 and neutralizing antibody titer (Focus Reduction Neutralization Titer50; hereinafter referred to as "$FRNT_{50}$") was measured for more than two years at Months 1, 2, 3, 5, 6, 7, 8, 9, 10, 12, 14, 16, 18, 20, 23 and 25.

Figure 2:
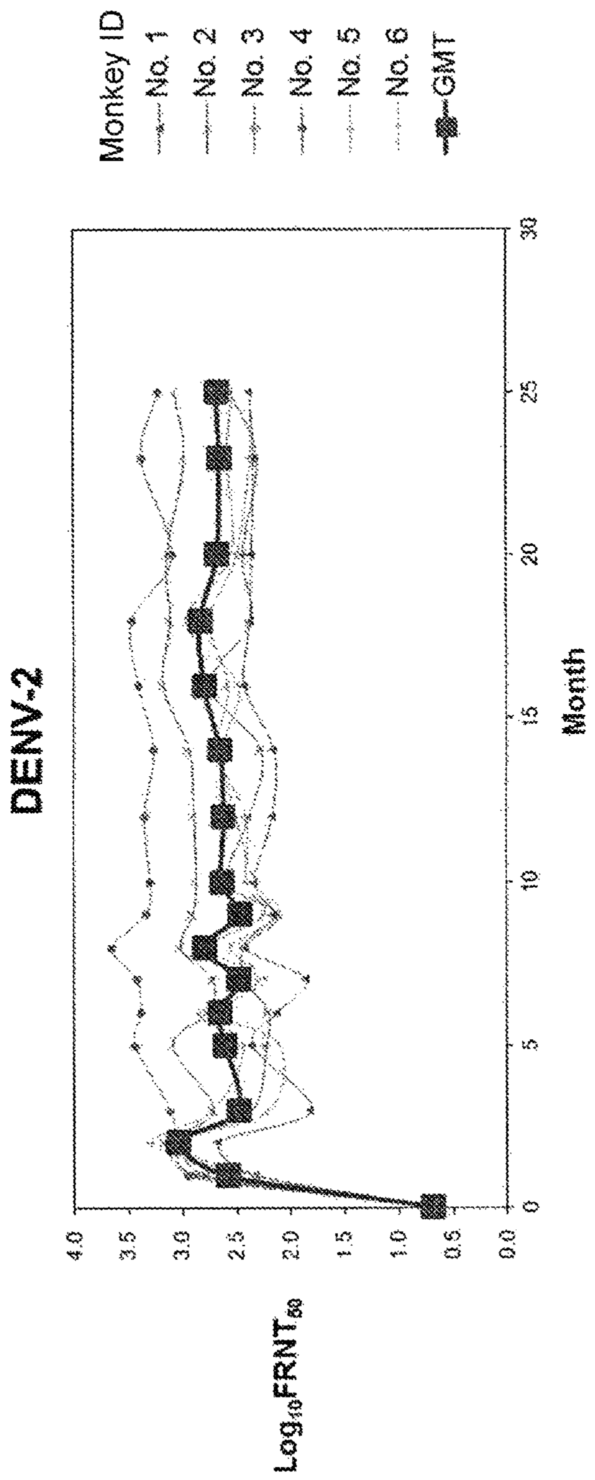
FIG. 2 shows long-term transition of neutralizing antibody titer (serotype 2).
Figure 3:
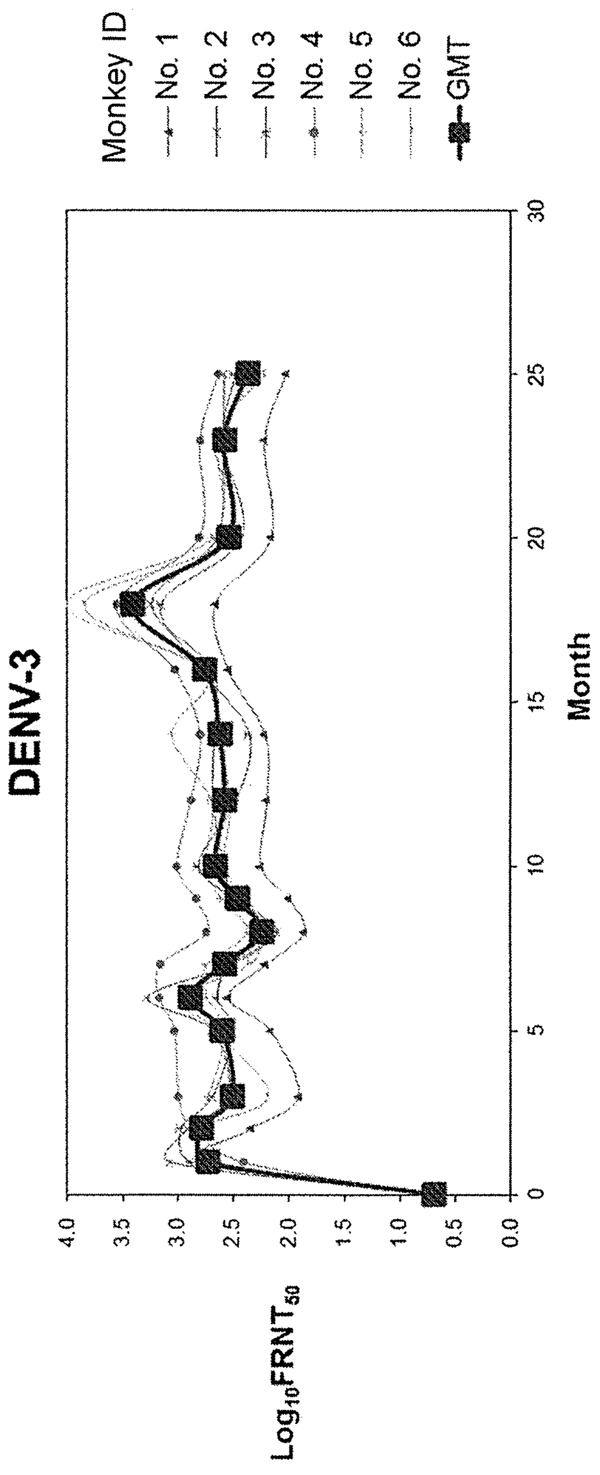
FIG. 3 shows long-term transition of neutralizing antibody titer (serotype 3).
Figure 4:
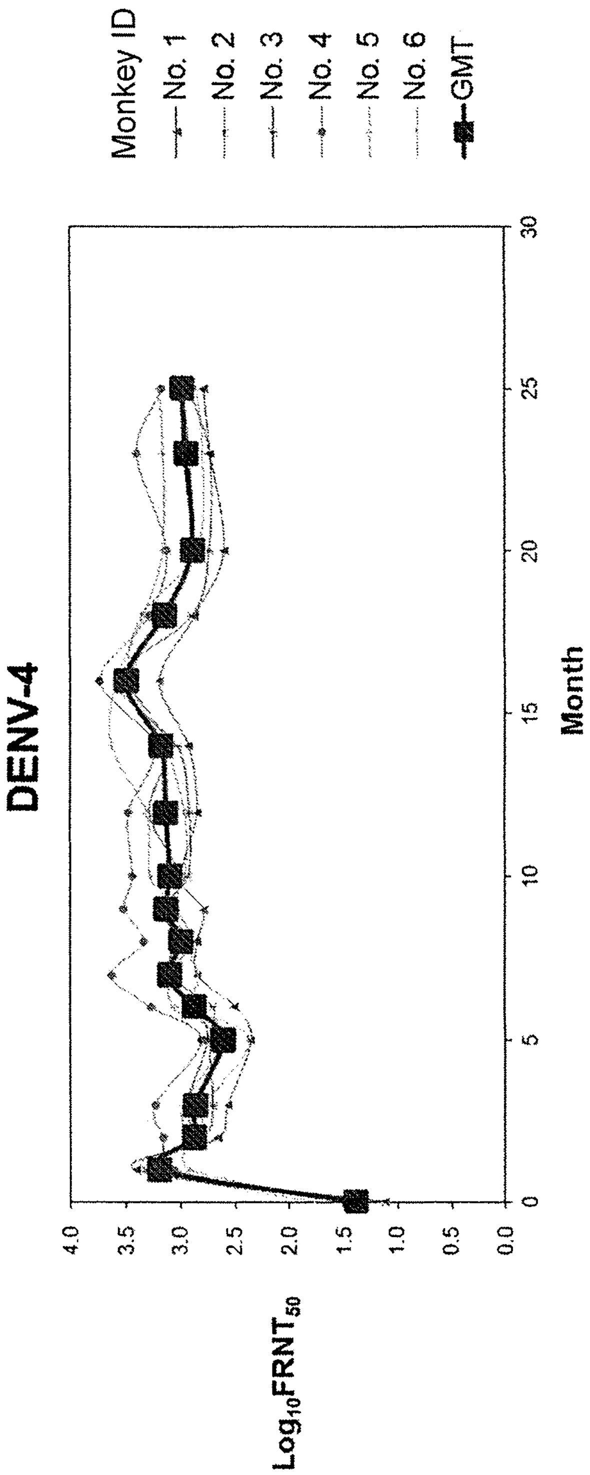
FIG. 4 shows long-term transition of neutralizing antibody titer (serotype 4).

As a result, positive conversion of neutralizing antibody ($FRNT_{50}$>10) was observed from all of the animals at Month 1 and thereafter. A geometrical mean of neutralizing antibody titer was 100 or more for any of serotypes 1 to 4. The neutralizing antibody titer was maintained at the same level for two years or more and no tendency of declination was observed (FIGS. 1 to 4).

Thus, the tetravalent dengue virus formulation (Formulation 5555), as showing efficacy for at least 2 years and no tendency of declination, is expected to maintain its neutralizing antibody titer for a long period of time.

(2) Investigation of Frequency and Interval of Inoculation

For evaluating frequency and interval of inoculation of the tetravalent dengue virus formulation (Formulation 5555), six in total of cynomolgus monkeys received inoculation of the Formulation 5555 with schedules of two inoculations with one-month interval and of two inoculations with six-month interval.

Figure 5:
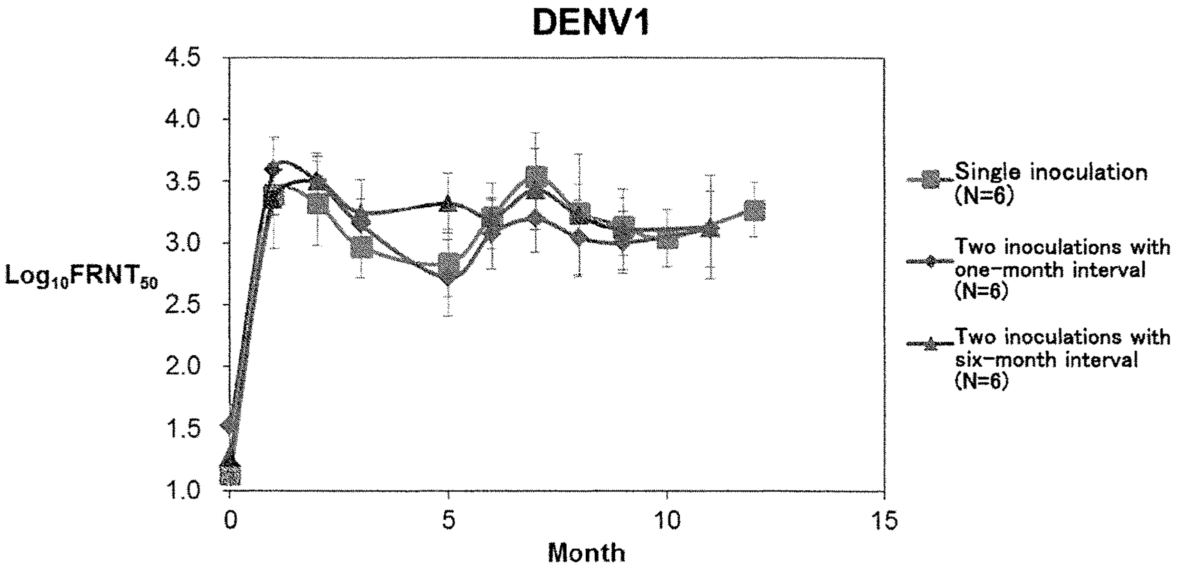
FIG. 5 shows long-term transition and independence of the number of inoculation of neutralizing antibody titer (serotype 1).
Figure 6:
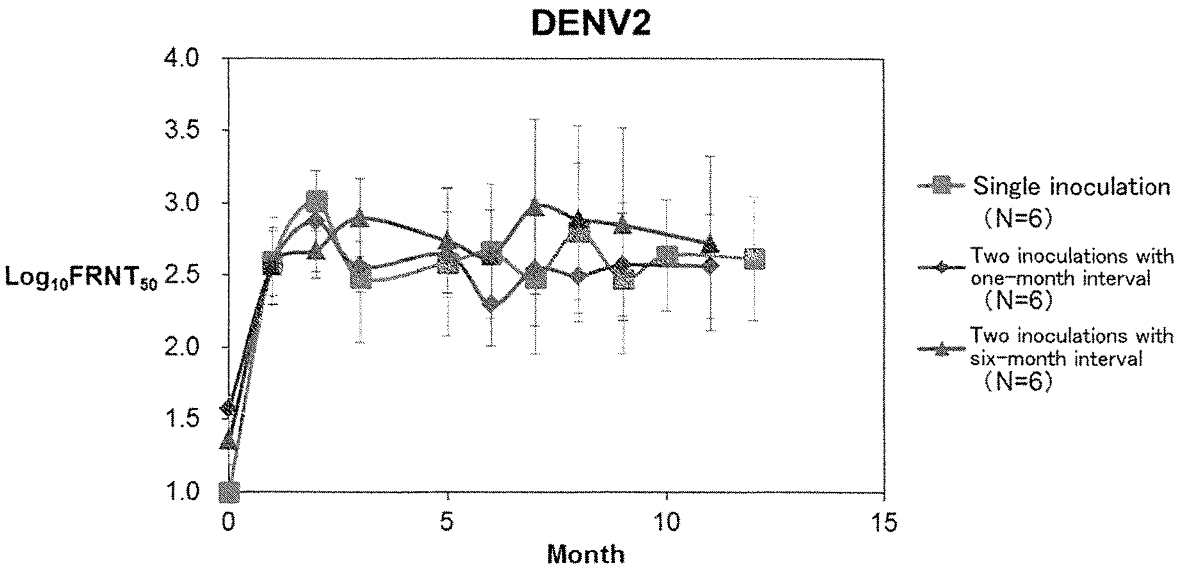
FIG. 6 shows long-term transition and independence of the number of inoculation of neutralizing antibody titer (serotype 2).
Figure 7:
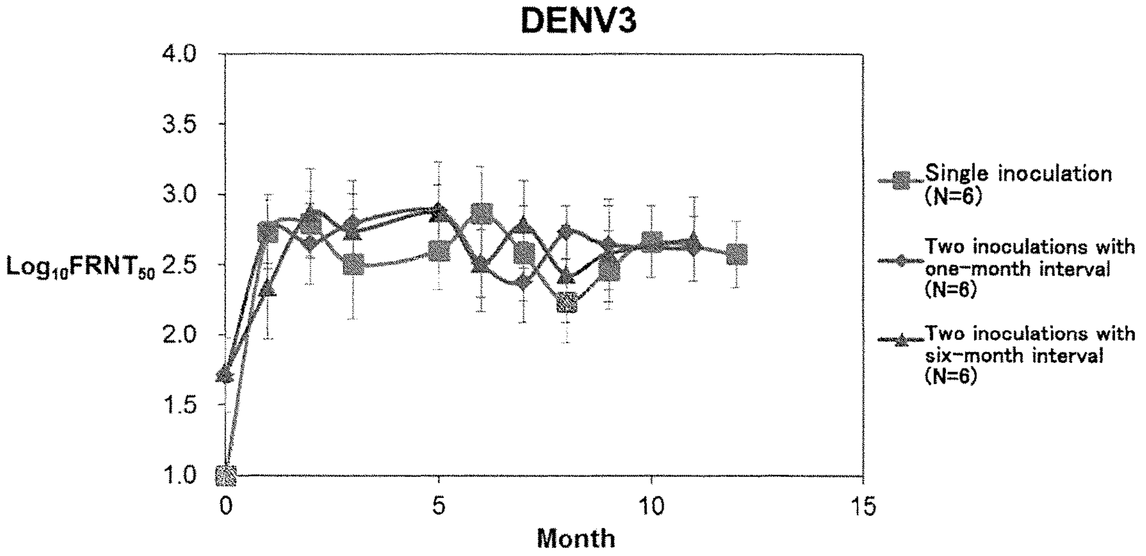
FIG. 7 shows long-term transition and independence of the number of inoculation of neutralizing antibody titer (serotype 3).
Figure 8:
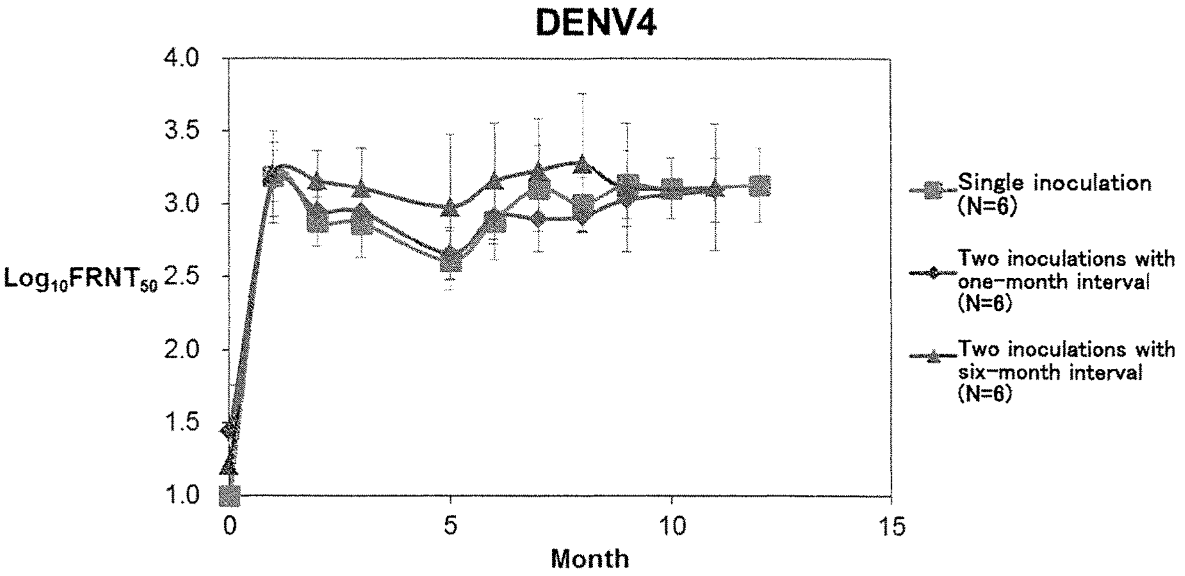
FIG. 8 shows long-term transition and independence of the number of inoculation of neutralizing antibody titer (serotype 4).

As a result, for both two inoculations with one-month interval and two inoculations with six-month interval, neutralizing antibody titer increased to the same extent as that of single inoculation and no significant change in neutralizing antibody titer was observed after the second inoculation. Therefore, a vaccine comprising the dengue virus attenuated strain of the present invention was suggested to be capable of inducing sufficient neutralizing antibody response with single inoculation (FIGS. 5 to 8; FIGS. 5 to 8 showed geometrical mean of neutralizing antibody titer when each 5 log 10 PFU/dose of the tetravalent dengue virus formulations were administered to cynomolgus monkeys with single inoculation (N=6), two inoculations with one-month interval (N=6) and two inoculations with six-month interval (N=6); vertical bars show ±SD.)

(3) Dosage Test

For investigating a response with different doses, tetravalent dengue virus formulations at each 5 log 10, each 3 log 10, each 2 log 10 and each 1 log 10 FFU/dose were prepared and administered to cynomolgus monkeys with single inoculation. The week of inoculation was set to Week 0 and neutralizing antibody titer was measured at Week 2 and Week 5.

Figure 9:
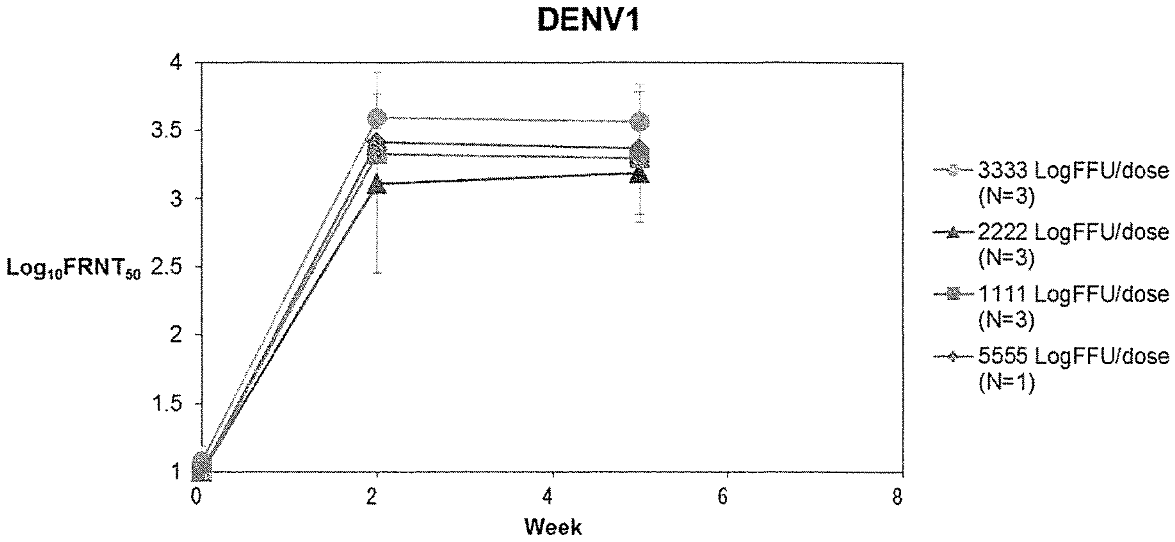
FIG. 9 shows independence of an antigenic amount of neutralizing antibody response (serotype 1).
Figure 10:
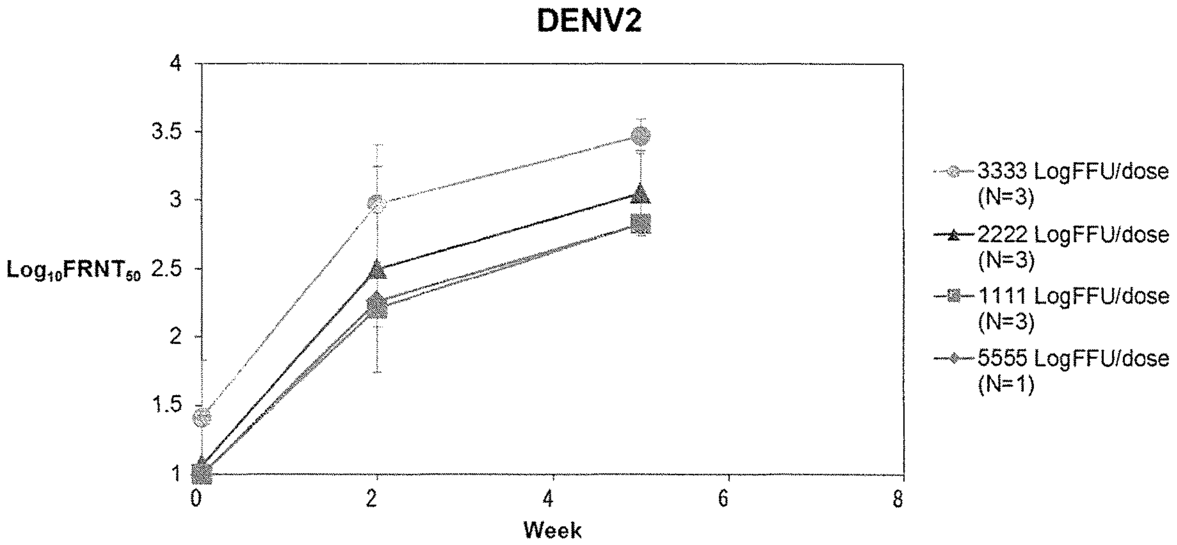
FIG. 10 shows independence of an antigenic amount of neutralizing antibody response (serotype 2).
Figure 11:
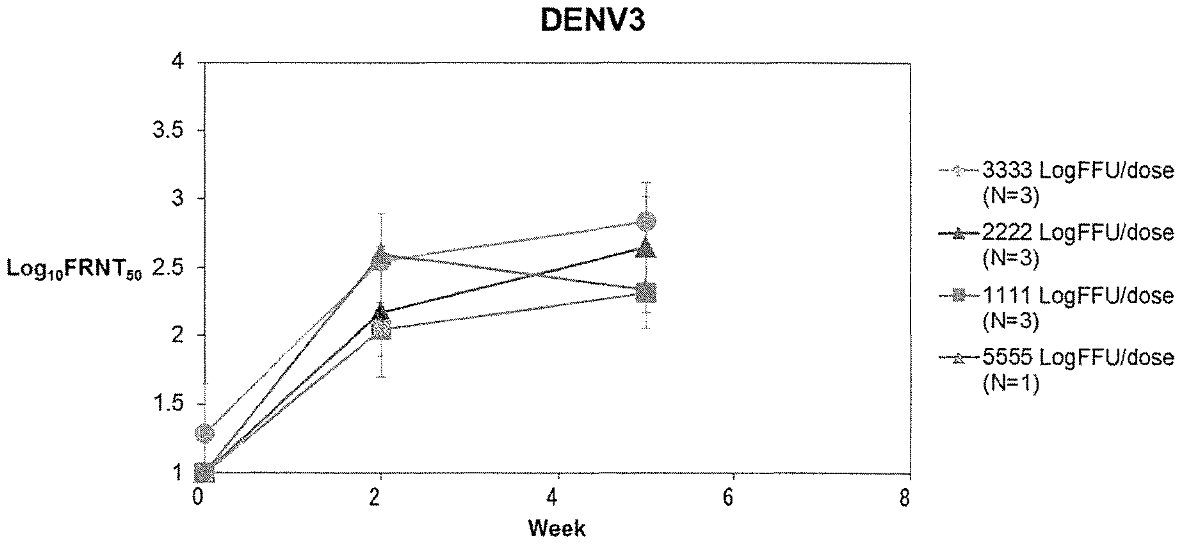
FIG. 11 shows independence of an antigenic amount of neutralizing antibody response (serotype 3).
Figure 12:
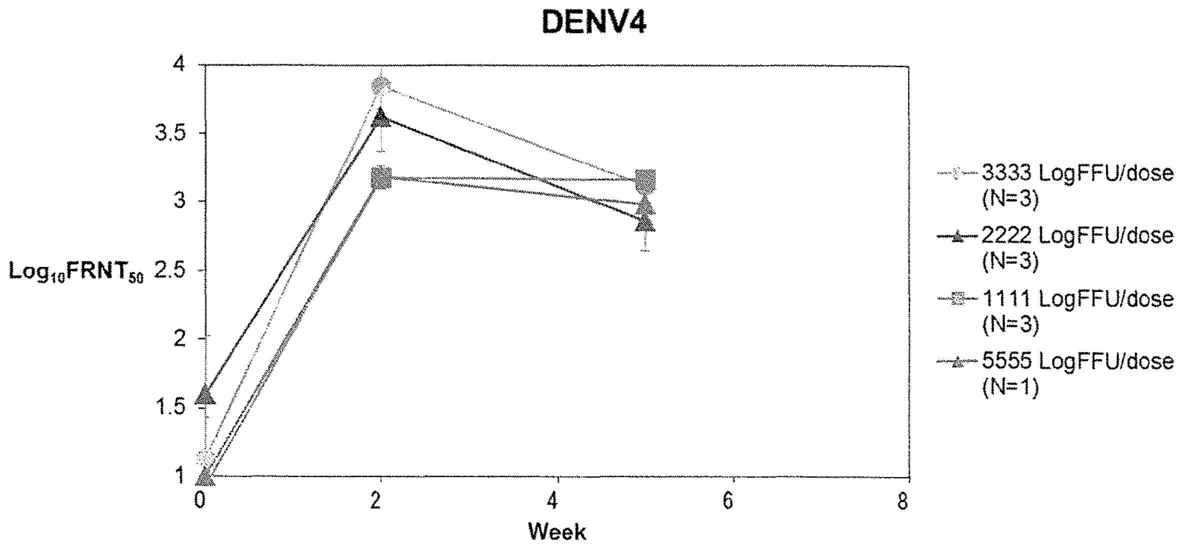
FIG. 12 shows independence of an antigenic amount of neutralizing antibody response (serotype 4).
Figure 13:
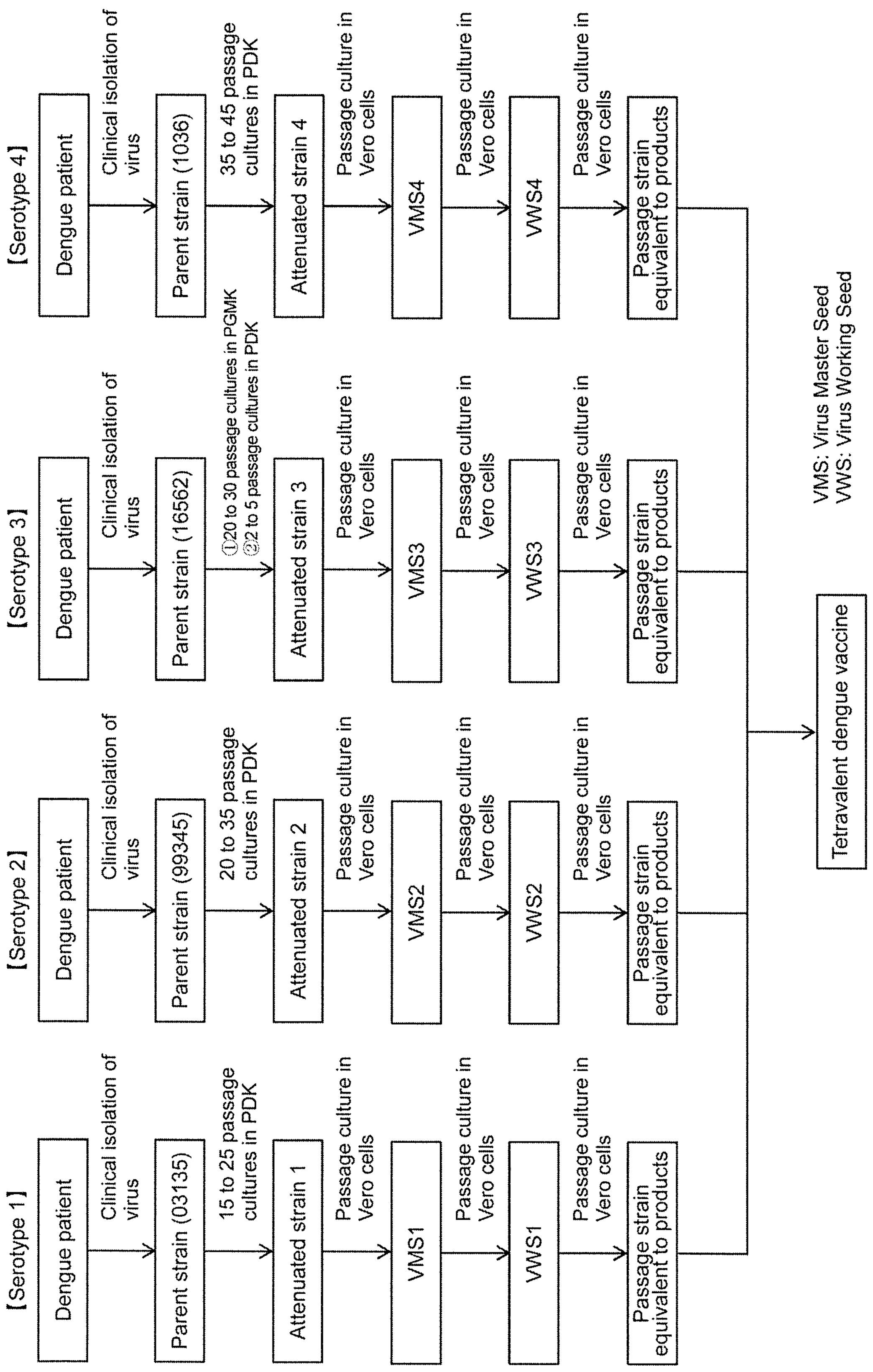
FIG. 13 shows a flow diagram of preparation for a tetravalent dengue vaccine.

As a result, positive conversion of neutralizing antibody was observed from all of the animals at Week 2 and the positivity was maintained at Week 5. Therefore, neutralizing antibody response was affirmed with an amount of antigen as low as each 1 log 10 FFU/dose (FIGS. 9 to 12; FIGS. 9 to 12 showed geometrical mean of neutralizing antibody titer when each 5 log 10 FFU/dose (N=1), each 3 log 10 FFU/dose (N=3), each 2 log 10 FFU/dose (N=3) and each 1 log 10 FFU/dose (N=3) of the tetravalent dengue virus formulations were administered to cynomolgus monkeys with single inoculation at Week 0, Week 2 and Week 5; vertical bars show ±SD.).

Example 6

(1) GLP efficacy Test

Pre-CTMs prepared in Example 1 were mixed to prepare tetravalent dengue vaccine formulations of 5555 Log 10 FFU/dose, 4444 Log 10 FFU/dose and 3333 Log 10 FFU/dose. The tetravalent dengue vaccine formulations as prepared or medium were administered to cynomolgus monkeys with single inoculation to evaluate an ability to induce neutralizing antibody and an ability to protect against challenge virus (parent strain).

Neutralizing antibody titer was obtained by Immunospot PRNT. Positive conversion of neutralizing antibody was observed for all of the animals from 5555 Log 10 FFU/dose inoculation group (N=24), 4444 Log 10 FFU/dose inoculation group (N=24) and 3333 Log 10 FFU/dose inoculation group (N=24) at Day 14 and thereafter (Tables 20 to 28). On the other hand, positive conversion of neutralizing antibody was not observed for media inoculation group (Tables 29, 30).

For evaluating an ability to protect against challenge virus (parent strain), each group was further divided into uniform groups each consisting of 6 animals and was subjected to subcutaneous challenge of monovalent parent strain of the respective serotypes at Day 60. An amount of challenge was set to 5 Log 10 PFU/dose, 5 Log 10 PFU/dose, 6 Log 10 PFU/dose and 5 Log 10 PFU/dose for the respective serotypes. 1, 2, 3, 4, 6, 8, 10, 14 Days after challenge, a virus genome level in serum was measured to reveal that a lot of virus genome was detected in the media inoculation group (each N=3) (Table 31) whereas no virus genome was detected in any of the vaccine inoculation groups.

TABLE 20

| Neutralizing antibody titer of 5555 Log10 FFU/dose inoculation group | | | | | |
|---|---|---|---|---|---|
| Animal | | Day 0 | | | |
| ID | Challenge | DENV1 | DENV2 | DENV3 | DENV4 |
| 5194 | DENV-1 | <10 | <10 | <10 | <10 |
| 5210 | DENV-1 | <10 | <10 | <10 | <10 |
| 5189 | DENV-1 | 17 | <10 | <10 | <10 |
| 5226 | DENV-1 | <10 | <10 | <10 | <10 |
| 5223 | DENV-1 | <10 | <10 | <10 | <10 |
| 5248 | DENV-1 | <10 | <10 | <10 | 19 |
| 5180 | DENV-2 | <10 | <10 | <10 | <10 |
| 5202 | DENV-2 | <10 | <10 | <10 | <10 |
| 5214 | DENV-2 | <10 | <10 | <10 | <10 |
| 5251 | DENV-2 | <10 | <10 | <10 | <10 |
| 5217 | DENV-2 | <10 | <10 | <10 | <10 |
| 5228 | DENV-2 | <10 | <10 | <10 | <10 |
| 5182 | DENV-3 | <10 | <10 | <10 | <10 |
| 5200 | DENV-3 | <10 | <10 | <10 | <10 |
| 5196 | DENV-3 | <10 | <10 | <10 | <10 |
| 5112 | DENV-3 | <10 | <10 | <10 | <10 |
| 5234 | DENV-3 | <10 | <10 | <10 | <10 |
| 5240 | DENV-3 | <10 | <10 | <10 | <10 |
| 5198 | DENV-4 | <10 | <10 | <10 | <10 |
| 5184 | DENV-4 | <10 | <10 | <10 | <10 |
| 5187 | DENV-4 | <10 | <10 | <10 | <10 |
| 5244 | DENV-4 | <10 | <10 | <10 | <10 |
| 5241 | DENV-4 | <10 | <10 | <10 | <10 |
| 5247 | DENV-4 | <10 | <10 | <10 | <10 |
| | Geometric Mean | 5.3 | 5 | 5 | 5.3 |
| | Geometric Mean (Log10) | 0.721 | 0.699 | 0.699 | 0.723 |
| | S.D. (Log10) | 0.108 | 0 | 0 | 0.118 |

TABLE 21

| Animal | | Day 14 | | | |
|---|---|---|---|---|---|
| ID | Challenge | DENV1 | DENV2 | DENV3 | DENV4 |
| 5194 | DENV-1 | 1742 | 363 | 506 | ≥10240 |
| 5210 | DENV-1 | 325 | 203 | 348 | 2533 |
| 5189 | DENV-1 | 560 | 126 | 566 | 4326 |
| 5226 | DENV-1 | 2297 | 1987 | 461 | 8960 |
| 5223 | DENV-1 | 2077 | 229 | 426 | 2542 |
| 5248 | DENV-1 | 2931 | 826 | 1882 | ≥10240 |
| 5180 | DENV-2 | 2773 | 537 | 1423 | ≥10240 |
| 5202 | DENV-2 | 677 | 3680 | 597 | ≥10240 |
| 5214 | DENV-2 | 3529 | 8528 | 400 | ≥10240 |
| 5251 | DENV-2 | 1870 | 133 | 140 | 6285 |
| 5217 | DENV-2 | 2444 | 571 | 1376 | ≥10240 |
| 5228 | DENV-2 | 3091 | 445 | 191 | ≥10240 |
| 5182 | DENV-3 | 1078 | 3325 | 135 | 5867 |
| 5200 | DENV-3 | 1953 | 562 | 617 | 3745 |
| 5196 | DENV-3 | 1807 | 396 | 145 | 7301 |
| 5112 | DENV-3 | 3736 | 1505 | 159 | 6115 |

TABLE 21-continued

| Animal | | Day 14 | | | |
|---|---|---|---|---|---|
| ID | Challenge | DENV1 | DENV2 | DENV3 | DENV4 |
| 5234 | DENV-3 | ≥10240 | 2216 | 546 | 6840 |
| 5240 | DENV-3 | 4287 | 581 | 366 | ≥10240 |
| 5198 | DENV-4 | 6884 | 477 | 1003 | ≥10240 |
| 5184 | DENV-4 | 8589 | 407 | 646 | ≥10240 |
| 5187 | DENV-4 | 1217 | 144 | 299 | 2244 |
| 5244 | DENV-4 | 427 | 80 | 36 | 4053 |
| 5241 | DENV-4 | 2453 | 351 | 120 | ≥10240 |
| 5247 | DENV-4 | 2547 | 815 | 377 | ≥10240 |
| | Geometric Mean | 2092.6 | 576.6 | 373.9 | 6881.6 |
| | Geometric Mean (Log10) | 3.321 | 2.761 | 2.573 | 3.838 |
| | S.D. (Log10) | 0.377 | 0.507 | 0.397 | 0.224 |

TABLE 22

| Animal | | Day 60 | | | |
|---|---|---|---|---|---|
| ID | Challenge | DENV1 | DENV2 | DENV3 | DENV4 |
| 5194 | DENV-1 | 1822 | 1028 | 409 | 644 |
| 5210 | DENV-1 | 1407 | 578 | 539 | 451 |
| 5189 | DENV-1 | 1899 | 8271 | 1077 | 418 |
| 5226 | DENV-1 | 1012 | 590 | 232 | 1341 |
| 5223 | DENV-1 | 2063 | 499 | 441 | 1652 |
| 5248 | DENV-1 | 1607 | ≥10240 | 534 | 1662 |
| 5180 | DENV-2 | 2144 | 1707 | 1296 | 1795 |
| 5202 | DENV-2 | 2268 | 1684 | 900 | 2157 |
| 5214 | DENV-2 | 1588 | 1223 | 384 | 644 |
| 5251 | DENV-2 | 1779 | 1336 | 194 | 1660 |
| 5217 | DENV-2 | 1644 | 585 | 350 | 1352 |
| 5228 | DENV-2 | 2046 | 822 | 401 | 1373 |
| 5182 | DENV-3 | 1932 | 1950 | 239 | 1571 |
| 5200 | DENV-3 | 1787 | 524 | 369 | 1417 |
| 5196 | DENV-3 | 2240 | 543 | 472 | 2916 |
| 5112 | DENV-3 | 1339 | 250 | 268 | 4964 |
| 5234 | DENV-3 | 9632 | 2216 | 276 | 3397 |
| 5240 | DENV-3 | 1957 | ≥10240 | 492 | 4224 |
| 5198 | DENV-4 | 4578 | 1640 | 485 | 629 |
| 5184 | DENV-4 | 5298 | 701 | 1189 | 954 |
| 5187 | DENV-4 | 5957 | 757 | 1244 | 1786 |
| 5244 | DENV-4 | 2244 | 1140 | 171 | 1526 |
| 5241 | DENV-4 | 3520 | 3968 | 415 | 1187 |
| 5247 | DENV-4 | 4050 | 5765 | 621 | 6578 |
| | Geometric Mean | 2333.7 | 1382.8 | 458.8 | 1511.7 |
| | Geometric Mean (Log10) | 3.368 | 3.141 | 2.662 | 3.179 |
| | S.D. (Log10) | 0.231 | 0.444 | 0.251 | 0.308 |

TABLE 23

| Neutralizing antibody titer of 4444 Log10 FFU/dose inoculation group | | | | | |
|---|---|---|---|---|---|
| Animal | | Day 0 | | | |
| ID | Challenge | DENV1 | DENV2 | DENV3 | DENV4 |
| 5216 | DENV-1 | <10 | <10 | <10 | <10 |
| 5199 | DENV-1 | <10 | <10 | <10 | <10 |
| 5201 | DENV-1 | <10 | <10 | <10 | <10 |
| 5231 | DENV-1 | <10 | <10 | <10 | <10 |
| 5256 | DENV-1 | <10 | <10 | <10 | <10 |
| 5097 | DENV-1 | <10 | <10 | <10 | <10 |
| 5203 | DENV-2 | <10 | <10 | <10 | <10 |

TABLE 23-continued

| Neutralizing antibody titer of 4444 Log10 FFU/dose inoculation group | | | | | |
|---|---|---|---|---|---|
| Animal | | Day 0 | | | |
| ID | Challenge | DENV1 | DENV2 | DENV3 | DENV4 |
| 5191 | DENV-2 | <10 | <10 | <10 | <10 |
| 5190 | DENV-2 | <10 | <10 | <10 | <10 |
| 5242 | DENV-2 | <10 | <10 | <10 | 28 |
| 5236 | DENV-2 | <10 | <10 | <10 | <10 |
| 5246 | DENV-2 | 16 | <10 | <10 | <10 |
| 5193 | DENV-3 | <10 | <10 | <10 | <10 |
| 5208 | DENV-3 | <10 | <10 | <10 | <10 |
| 5213 | DENV-3 | <10 | <10 | <10 | 19 |
| 5245 | DENV-3 | <10 | <10 | <10 | <10 |
| 5225 | DENV-3 | <10 | <10 | <10 | <10 |
| 5238 | DENV-3 | <10 | <10 | <10 | <10 |
| 5185 | DENV-4 | 18 | <10 | <10 | <10 |
| 5192 | DENV-4 | <10 | <10 | <10 | <10 |
| 5183 | DENV-4 | <10 | <10 | <10 | <10 |
| 5221 | DENV-4 | 10 | <10 | <10 | <10 |
| 5235 | DENV-4 | <10 | <10 | <10 | <10 |
| 5222 | DENV-4 | <10 | 238 | <10 | <10 |
| | Geometric Mean | 5.7 | 5.9 | 5 | 5.7 |
| | Geometric Mean (Log10) | 0.756 | 0.769 | 0.699 | 0.754 |
| | S.D. (Log10) | 0.159 | 0.342 | 0 | 0.189 |

TABLE 24

| Animal | | Day 14 | | | |
|---|---|---|---|---|---|
| ID | Challenge | DENV1 | DENV2 | DENV3 | DENV4 |
| 5216 | DENV-1 | 5295 | 1687 | 223 | 8533 |
| 5199 | DENV-1 | 2263 | 1312 | 850 | ≥10240 |
| 5201 | DENV-1 | 5312 | 469 | 474 | 9882 |
| 5231 | DENV-1 | 2209 | 398 | 430 | 8418 |
| 5256 | DENV-1 | 1598 | 423 | 1014 | 6018 |
| 5097 | DENV-1 | ≥10240 | 2108 | 1641 | ≥10240 |
| 5203 | DENV-2 | 2123 | 275 | 44 | ≥10240 |
| 5191 | DENV-2 | 3627 | 1516 | 1311 | ≥10240 |
| 5190 | DENV-2 | 4937 | 526 | 301 | 8731 |
| 5242 | DENV-2 | 300 | 4622 | 78 | ≥10240 |
| 5236 | DENV-2 | 3413 | 2151 | 542 | ≥10240 |
| 5246 | DENV-2 | 5842 | 588 | 500 | ≥10240 |
| 5193 | DENV-3 | 4794 | 168 | 577 | ≥10240 |
| 5208 | DENV-3 | 7832 | 1144 | 1308 | 8236 |
| 5213 | DENV-3 | 1859 | 157 | 155 | 2099 |
| 5245 | DENV-3 | 7767 | 1959 | 133 | ≥10240 |
| 5225 | DENV-3 | 521 | 251 | 310 | 5582 |
| 5238 | DENV-3 | 5938 | 387 | 346 | ≥10240 |
| 5185 | DENV-4 | 4673 | 716 | 515 | 6800 |
| 5192 | DENV-4 | 549 | 248 | 35 | 6013 |
| 5183 | DENV-4 | ≥10240 | 275 | 457 | ≥10240 |
| 5221 | DENV-4 | 4788 | 364 | 462 | 7795 |
| 5235 | DENV-4 | ≥10240 | 539 | 807 | ≥10240 |
| 5222 | DENV-4 | ≥10240 | 1996 | 265 | ≥10240 |
| | Geometric Mean | 3502 | 662.9 | 365.4 | 8408.7 |
| | Geometric Mean (Log10) | 3.544 | 2.821 | 2.563 | 3.925 |
| | S.D. (Log10) | 0.424 | 0.405 | 0.436 | 0.154 |

TABLE 25

| Animal | | Day 60 | | | |
|---|---|---|---|---|---|
| ID | Challenge | DENV1 | DENV2 | DENV3 | DENV4 |
| 5216 | DENV-1 | 1552 | 4668 | 120 | 563 |
| 5199 | DENV-1 | 2110 | 519 | 148 | 1335 |
| 5201 | DENV-1 | 3067 | 2496 | 515 | 1725 |
| 5231 | DENV-1 | 3617 | 4736 | 1370 | 1897 |
| 5256 | DENV-1 | 2447 | 5730 | 1629 | 2015 |
| 5097 | DENV-1 | 5142 | 4745 | 1916 | 4441 |
| 5203 | DENV-2 | 1265 | 947 | 136 | 1146 |
| 5191 | DENV-2 | 1236 | 369 | 116 | 2733 |
| 5190 | DENV-2 | 2958 | 1673 | 153 | 1989 |
| 5242 | DENV-2 | 1611 | 738 | 114 | 1806 |
| 5236 | DENV-2 | 1243 | 459 | 99 | 2010 |
| 5246 | DENV-2 | 2871 | 1830 | 414 | 8240 |
| 5193 | DENV-3 | 1623 | 597 | 336 | 573 |
| 5208 | DENV-3 | 3497 | 2250 | 595 | 1793 |
| 5213 | DENV-3 | 6000 | 1388 | 427 | 2212 |
| 5245 | DENV-3 | 2200 | 1382 | 246 | 1502 |
| 5225 | DENV-3 | 2203 | 348 | 309 | 942 |
| 5238 | DENV-3 | 4033 | 2290 | 417 | 2001 |
| 5185 | DENV-4 | 4150 | 513 | 559 | 1760 |
| 5192 | DENV-4 | 1480 | 211 | 108 | 951 |
| 5183 | DENV-4 | 1615 | 242 | 307 | 598 |
| 5221 | DENV-4 | 2262 | 2168 | 483 | 2067 |
| 5235 | DENV-4 | 3086 | 1650 | 403 | 1248 |
| 5222 | DENV-4 | 7663 | 5186 | 466 | 1742 |
| | Geometric Mean | 2519.8 | 1264.9 | 325.5 | 1627.2 |
| | Geometric Mean (Log10) | 3.401 | 3.102 | 2.513 | 3.211 |
| | S.D. (Log10) | 0.222 | 0.443 | 0.374 | 0.261 |

TABLE 26

| Neutralizing antibody titer of 3333 Log10 FFU/dose inoculation group | | | | | |
|---|---|---|---|---|---|
| Animal | | Day 0 | | | |
| ID | Challenge | DENV1 | DENV2 | DENV3 | DENV4 |
| 5212 | DENV-1 | <10 | <10 | <10 | <10 |
| 5188 | DENV-1 | <10 | <10 | <10 | 14 |
| 5207 | DENV-1 | <10 | <10 | <10 | <10 |
| 5218 | DENV-1 | <10 | <10 | <10 | <10 |
| 5237 | DENV-1 | <10 | <10 | <10 | <10 |
| 5233 | DENV-1 | <10 | <10 | <10 | <10 |
| 5205 | DENV-2 | <10 | <10 | <10 | <10 |
| 5181 | DENV-2 | <10 | <10 | <10 | <10 |
| 5179 | DENV-2 | <10 | <10 | <10 | <10 |
| 5243 | DENV-2 | <10 | <10 | <10 | <10 |
| 5220 | DENV-2 | <10 | <10 | <10 | <10 |
| 5219 | DENV-2 | <10 | <10 | <10 | <10 |
| 5206 | DENV-3 | <10 | <10 | 14 | <10 |
| 5204 | DENV-3 | <10 | <10 | <10 | <10 |
| 5175 | DENV-3 | <10 | <10 | <10 | <10 |
| 5227 | DENV-3 | <10 | <10 | <10 | <10 |
| 5224 | DENV-3 | <10 | <10 | 39 | 130 |
| 5239 | DENV-3 | <10 | <10 | <10 | <10 |
| 5176 | DENV-4 | <10 | <10 | <10 | <10 |
| 5177 | DENV-4 | <10 | <10 | <10 | 19 |
| 5211 | DENV-4 | <10 | <10 | <10 | <10 |
| 5254 | DENV-4 | <10 | <10 | <10 | <10 |
| 5252 | DENV-4 | <10 | <10 | <10 | <10 |
| 5255 | DENV-4 | <10 | <10 | <10 | <10 |
| | Geometric Mean | 5 | 5 | 5.7 | 6.3 |
| | Geometric Mean (Log10) | 0.699 | 0.699 | 0.755 | 0.801 |
| | S.D. (Log10) | 0 | 0 | 0.2 | 0.316 |

TABLE 27

| Animal | | Day 14 | | | |
|---|---|---|---|---|---|
| ID | Challenge | DENV1 | DENV2 | DENV3 | DENV4 |
| 5212 | DENV-1 | 1438 | 511 | 1444 | 10174 |
| 5188 | DENV-1 | 6391 | 751 | 2453 | 7175 |
| 5207 | DENV-1 | 1520 | 484 | 406 | 7226 |
| 5218 | DENV-1 | 9267 | 1660 | 1001 | 8889 |
| 5237 | DENV-1 | 6192 | 593 | 607 | 8418 |
| 5233 | DENV-1 | 10083 | 579 | 546 | ≥10240 |
| 5205 | DENV-2 | 7585 | 489 | 102 | 587 |
| 5181 | DENV-2 | 6705 | 2262 | 121 | 2384 |
| 5179 | DENV-2 | 1116 | 123 | 188 | 9863 |
| 5243 | DENV-2 | 4622 | 743 | 146 | 6908 |
| 5220 | DENV-2 | 2388 | 128 | 143 | ≥10240 |
| 5219 | DENV-2 | ≥10240 | ≥10240 | 2481 | 9539 |
| 5206 | DENV-3 | 1483 | 576 | 481 | ≥10240 |
| 5204 | DENV-3 | 5370 | 1864 | 238 | ≥10240 |
| 5175 | DENV-3 | ≥10240 | 1805 | 73 | ≥10240 |
| 5227 | DENV-3 | ≥10240 | 1618 | 2421 | ≥10240 |
| 5224 | DENV-3 | 2040 | 507 | 547 | 6261 |
| 5239 | DENV-3 | 3310 | 1491 | 98 | ≥10240 |
| 5176 | DENV-4 | 9764 | 513 | 846 | 2423 |
| 5177 | DENV-4 | ≥10240 | 2487 | 9526 | ≥10240 |
| 5211 | DENV-4 | 8827 | 389 | 4833 | ≥10240 |
| 5254 | DENV-4 | 9920 | 379 | 520 | 3963 |
| 5252 | DENV-4 | ≥10240 | 574 | 534 | 7796 |
| 5255 | DENV-4 | ≥10240 | 538 | 1590 | ≥10240 |
| | Geometric Mean | 5323.5 | 770.7 | 563.9 | 7031.4 |
| | Geometric Mean (Log10) | 3.726 | 2.887 | 2.751 | 3.847 |
| | S.D. (Log10) | 0.335 | 0.417 | 0.572 | 0.296 |

TABLE 28

| Animal | | Day 60 | | | |
|---|---|---|---|---|---|
| ID | Challenge | DENV1 | DENV2 | DENV3 | DENV4 |
| 5212 | DENV-1 | 1333 | 4328 | 504 | 1174 |
| 5188 | DENV-1 | 2869 | 2347 | 597 | 547 |
| 5207 | DENV-1 | 3906 | 4693 | 262 | 1040 |
| 5218 | DENV-1 | 1449 | 1938 | 398 | 862 |
| 5237 | DENV-1 | 2601 | ≥10240 | 2736 | 1908 |
| 5233 | DENV-1 | 6080 | ≥10240 | 2031 | 3956 |
| 5205 | DENV-2 | 2072 | 1912 | 383 | 1926 |
| 5181 | DENV-2 | 5256 | 2018 | 766 | 2456 |
| 5179 | DENV-2 | 2240 | 155 | 144 | 2483 |
| 5243 | DENV-2 | 1788 | 147 | 133 | 578 |
| 5220 | DENV-2 | 2067 | 4274 | 230 | 1678 |
| 5219 | DENV-2 | 3722 | 2029 | 455 | 3787 |
| 5206 | DENV-3 | 2134 | 916 | 179 | 562 |
| 5204 | DENV-3 | 3351 | 1213 | 139 | 910 |
| 5175 | DENV-3 | 7088 | ≥10240 | 472 | 2222 |
| 5227 | DENV-3 | 8080 | 2710 | 287 | 1595 |
| 5224 | DENV-3 | 3123 | 6240 | 354 | 1540 |
| 5239 | DENV-3 | 1849 | 3031 | 176 | 1025 |
| 5176 | DENV-4 | 2121 | 571 | 432 | 1943 |
| 5177 | DENV-4 | 7723 | 4722 | 813 | 1094 |
| 5211 | DENV-4 | 1084 | 189 | 497 | 2910 |
| 5254 | DENV-4 | 1806 | 591 | 336 | 4053 |
| 5252 | DENV-4 | 5107 | 564 | 294 | 2058 |
| 5255 | DENV-4 | 3852 | 365 | 498 | 2267 |
| | Geometric Mean | 2938.2 | 1683 | 393.1 | 1584.5 |
| | Geometric Mean (Log10) | 3.468 | 3.226 | 2.594 | 3.2 |
| | S.D. (Log10) | 0.248 | 0.564 | 0.327 | 0.259 |

TABLE 29

| Neutralizing antibody titer of media inoculation group | | | | | |
|---|---|---|---|---|---|
| Animal | | Day 0 | | | |
| ID | Challenge | DENV1 | DENV2 | DENV3 | DENV4 |
| 5178 | DENV-1 | <10 | N/A | N/A | N/A |
| 5195 | DENV-1 | 16 | N/A | N/A | N/A |
| 5232 | DENV-1 | <10 | N/A | N/A | N/A |
| 5197 | DENV-2 | N/A | <10 | N/A | N/A |
| 5249 | DENV-2 | N/A | <10 | N/A | N/A |
| 5253 | DENV-2 | N/A | <10 | N/A | N/A |
| 5209 | DENV-3 | N/A | N/A | <10 | N/A |
| 5215 | DENV-3 | N/A | N/A | <10 | N/A |
| 5230 | DENV-3 | N/A | N/A | <10 | N/A |
| 5186 | DENV-4 | N/A | N/A | N/A | <10 |
| 5229 | DENV-4 | N/A | N/A | N/A | <10 |
| 5250 | DENV-4 | N/A | N/A | N/A | <10 |
| | Geometric Mean | 7.4 | 5 | 5 | 5 |
| | Geometric Mean (Log10) | 0.867 | 0.699 | 0.699 | 0.699 |
| | S.D. (Log10) | 0.292 | 0 | 0 | 0 |

TABLE 30

| Animal | | Day 60 | | | |
|---|---|---|---|---|---|
| ID | Challenge | DENV1 | DENV2 | DENV 3 | DENV4 |
| 5178 | DENV-1 | <10 | N/A | N/A | N/A |
| 5195 | DENV-1 | <10 | N/A | N/A | N/A |
| 5232 | DENV-1 | <10 | N/A | N/A | N/A |
| 5197 | DENV-2 | N/A | <10 | N/A | N/A |
| 5249 | DENV-2 | N/A | <10 | N/A | N/A |
| 5253 | DENV-2 | N/A | <10 | N/A | N/A |
| 5209 | DENV-3 | N/A | N/A | <10 | N/A |
| 5215 | DENV-3 | N/A | N/A | <10 | N/A |
| 5230 | DENV-3 | N/A | N/A | <10 | N/A |
| 5186 | DENV-4 | N/A | N/A | N/A | <10 |
| 5229 | DENV-4 | N/A | N/A | N/A | <10 |
| 5250 | DENV-4 | N/A | N/A | N/A | <10 |
| | Geometric Mean | 5 | 5 | 5 | 5 |
| | Geometric Mean (Log10) | 0.699 | 0.699 | 0.699 | 0.699 |
| | S.D. (Log10) | 0 | 0 | 0 | 0 |

TABLE 31

Blood genome level in the media inoculation group after challenge

| Animal ID | Day 61 | Day 62 | Day 63 | Day 64 | Day 66 | Day 68 | Day 70 | Day 74 |
|---|---|---|---|---|---|---|---|---|
| DENV1 parent strain challenge | | | | | | | | |
| 5178 | 4128705 | 1926362 | 87628 | 15776 | 2124 | <900 | <900 | <900 |
| 5195 | 6359591 | 4385331 | 231334 | <900 | 5638 | <900 | <900 | <900 |
| 5232 | 9687626 | 3361351 | 258996 | 35269 | 4916 | <900 | <900 | <900 |
| Geometric Mean | 6336072 | 3050830 | 173803.5 | 6302.81 | 3890.13 | <900 | <900 | <900 |
| Geometric Mean (Log10) | 6.8 | 6.48 | 5.24 | 3.8 | 3.59 | <2.95 | <2.95 | <2.95 |
| S.D. (Log10) | 6.45 | 6.09 | 4.96 | 4.24 | 3.27 | 0 | 0 | 0 |
| DENV2 parent strain challenge | | | | | | | | |
| 5197 | 44597 | 626619 | 224564 | <2600 | <2600 | <2600 | <2600 | <2600 |
| 5249 | 29291 | 219807 | 88356 | 2746 | <2600 | <2600 | <2600 | <2600 |
| 5253 | 97557 | 282580 | 47556 | <2600 | <2600 | <2600 | <2600 | <2600 |
| Geometric Mean | 50322.95 | 338892.7 | 98083.02 | <2600 | <2600 | <2600 | <2600 | <2600 |
| Geometric Mean (Log10) | 4.7 | 5.53 | 4.99 | <3.41 | <3.41 | <3.41 | <3.41 | <3.41 |
| S.D. (Log10) | 4.55 | 5.34 | 4.97 | 0 | 0 | 0 | 0 | 0 |
| DENV3 parent strain challenge | | | | | | | | |
| 5209 | 2860 | 8086 | 3783 | <1800 | <1800 | <1800 | <1800 | <1800 |
| 5215 | 12796 | <1800 | <1800 | <1800 | <1800 | <1800 | <1800 | <1800 |
| 5230 | 28206 | 2967 | <1800 | <1800 | <1800 | <1800 | <1800 | <1800 |
| Geometric Mean | 10106.34 | 2784.61 | <1800 | <1800 | <1800 | <1800 | <1800 | <1800 |
| Geometric Mean (Log10) | 4 | 3.44 | <3.26 | <3.26 | <3.26 | <3.26 | <3.26 | <3.26 |
| S.D. (Log10) | 4.11 | 3.57 | 0 | 0 | 0 | 0 | 0 | 0 |
| DENV4 parent strain challenge | | | | | | | | |
| 5186 | 6410305 | 6519404 | <1800 | <1800 | <1800 | <1800 | <1800 | <1800 |
| 5229 | 3913816 | 1295282 | <1800 | <1800 | <1800 | <1800 | <1800 | <1800 |
| 5250 | 11990239 | 6372930 | <1800 | <1800 | <1800 | <1800 | <1800 | <1800 |
| Geometric Mean | 6700424 | 3775465 | <1800 | <1800 | <1800 | <1800 | <1800 | <1800 |
| Geometric Mean (Log10) | 6.83 | 6.58 | <3.26 | <3.26 | <3.26 | <3.26 | <3.26 | <3.26 |
| S.D. (Log10) | 6.62 | 6.47 | 0 | 0 | 0 | 0 | 0 | 0 |

Example 7

(1) Monkey Neurovirulence Test

Monkey neurovirulence test was conducted using VMS as a test substance in accordance with WHO protocol (Technical Report Series No. 978, 2013). Assigning 12 cynomolgus monkeys to each group, the respective serotypes of VMS at 5 Log 10 FFU/dose, 5 Log 10 PFU/dose, 5 Log 10 FFU/dose and 5 Log 10 FFU/dose, respectively, and Yellow Fever 17D at 5 Log 10 PFU/dose as a reference virus were administered intracranially to the animals. After administration, clinical scoring for 30 days was obtained and after 30 days necropsy was conducted only to the brain tissue and the spinal cord. As a result, no clinicopathologic and histopathological finding, problematic with regard to neurotoxicity, was observed.

Example 8

(1) GLP Repeated Dose Toxicity Study

Pre-CTMs prepared in Example 1 were tetravalent mixed to prepare tetravalent dengue vaccine formulations of 7777 Log 10 FFU/dose (5 mL) and 5555 Log 10 FFU/dose (0.5 mL). The tetravalent dengue vaccine formulations or medium were administered subcutaneously to each six of male and female cynomolgus monkeys thrice with four-week interval to conduct toxicity test of repetitive administration. For evaluating toxicity and reversibility of test substance, half of the cynomolgus monkeys were subjected to necropsy 3 days after the final administration and the remaining half were subjected to necropsy 28 days after the final administration.

Evaluation items were clinical signs, general behavior and neurobehavioral function, skin reaction, body weight, food consumption, body temperature, ophthalmology, electrocardiography, respiratory rate, urinalysis, hematology, blood chemistry, necropsy, organ weights, histopathology and quantitative examination of testes.

No death of individuals in any of the administration groups was found during the period of administration and the period of recovery of the repeated dose toxicity test. Also, during the period of administration and the period of recovery, no change relating to test substance was observed in clinical signs, general behavior and neurobehavioral function, skin reaction, body weight, food consumption, body temperature, ophthalmology, electrocardiography, respiratory rate, urinalysis, necropsy, organ weights and quantitative examination of testes for both male and female administration groups.

Hematologically, increase in the number of leucocytes, neutrophils, lymphocytes, monocytes, basophils and large non-stain cells was observed in some individuals, which was thought however to be a secondary change caused by inflammation or immune response at the inoculation site which was not toxicologically significant. Histopathologically, infiltration of inflammatory cells around the blood vessel was observed only at the inoculation site to the extent of minute to moderate, which however recovered or showed tendency of recovery within four weeks after the third administration.

From the above results, 7777 Log 10 FFU/dose was concluded to be no-observed-adverse-effect level in this test.

INDUSTRIAL APPLICABILITY

The present invention can be used as a vaccine using dengue virus.

| | | |
|---|---|---|
| 0-1 | Form PCT/RO/134 Indication regarding this deposited microorganism or other biological material (PCT Rule 13bis) was prepared as described in the right column | |
| 0-1-1 | | JPO-PAS i290 |
| 0-2 | International filing No. | |
| 0-3 | Document code of applicant or agent | 673093 |
| 1 | The following indication relates to microorganism or other biological material described in the detailed explanation of the invention | |
| 1-1 | Paragraph | 0028 |
| 1-3 | Indication of deposit | |
| 1-3-1 | Name of deposit organization | ATCC American Type Culture Collection |
| 1-3-2 | Address of deposit organization | 10801 University Blvd. Manassas, VA 20110-2209, USA |
| 1-3-3 | Date of deposit | Oct. 19, 2016 (19.10.2016) |
| 1-3-4 | Deposit number | PTA-123506 |
| 1-5 | Designation states for this indication | All |
| 2 | The following indication relates to microorganism or other biological material described in the detailed explanation of the invention | |
| 2-1 | Paragraph | 0028 |
| 2-3 | Indication of deposit | |
| 2-3-1 | Name of deposit organization | ATCC American Type Culture Collection |
| 2-3-2 | Address of deposit organization | 10801 University Blvd. Manassas, VA 20110-2209, USA |
| 2-3-3 | Date of deposit | Oct. 19, 2016 (19.10.2016) |
| 2-3-4 | Deposit number | PTA-123505 |
| 2-5 | Designation states for this indication | All |
| 3 | The following indication relates to microorganism or other biological material described in the detailed explanation of the invention | |

-continued

| | | |
|---|---|---|
| 3-1 | Paragraph | 0028 |
| 3-3 | Indication of deposit | |
| 3-3-1 | Name of deposit organization | ATCC American Type Culture Collection |
| 3-3-2 | Address of deposit organization | 10801 University Blvd. Manassas, VA 20110-2209, USA |
| 3-3-3 | Date of deposit | Oct. 19, 2016 (19.10.2016) |
| 3-3-4 | Deposit number | PTA-123507 |
| 3-5 | Designation states for this indication | All |
| 4 | The following indication relates to microorganism or other biological material described in the detailed explanation of the invention | |
| 4-1 | Paragraph | 0028 |
| 4-3 | Indication of deposit | |
| 4-3-1 | Name of deposit organization | ATCC American Type Culture Collection |
| 4-3-2 | Address of deposit organization | 10801 University Blvd. Manassas, VA 20110-2209, USA |
| 4-3-3 | Date of deposit | Oct. 19, 2016 (19.10.2016) |
| 4-3-4 | Deposit number | PTA-123508 |
| 4-5 | Designation states for this indication Al | |
| | For Receiving Office | |
| 0-4 | This paper was received with International application (Yes/No) | |
| 0-4-1 | Authority | |
| | For International Bureau | |
| 0-5 | Date of reception of this paper by International Bureau | |
| 0-5-1 | Authority | |

SEQUENCE LISTING (32 sequences)

SEQ ID NO: 1 - protein, 3392 aa, Dengue virus type 1
  VARIANT (199)..(199): Xaa stands for Lys or Glu
  VARIANT (999)..(999): Xaa stands for Val or Ile
  VARIANT (2353)..(2353): Xaa stands for Thr or Ile
  VARIANT (2360)..(2360): Xaa stands for Val or Ala
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGXHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRNTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNSTFIIDGPNTPECPDDQRAWNIWEVEDYGFGIFTTNIWLKLRDSYTQLCDHRLMSAAIKDSKAVHADMGYWIESEKNETWKLARASFIEVKTCXWPKSHTLWSNGVLESEMIIPKIYGGPISQHNYRPGYFTQTVGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLXAAVLMLXAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 2 - protein, 3391 aa, Dengue virus type 2
  VARIANT (398)..(398): Xaa stands for Lys or Met
  VARIANT (484)..(484): Xaa stands for Lys or Arg
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVGIQEKGKSLLFKTEDGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAXFTCKKNMEGKIVQPENLEYTIVVTPHSGEEHAVGNDTGKHGKEIKVTPQSSITEAELTGYGTVTMECSPRTGLDFNEMVLLQMENXAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQVAGPWHLGKLEMDFDFCDGTTVIVTEDCGNRGPSLRTTTASGKLITEWCCRSCTLPPLRYRGEDGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLLLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPVTAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLIAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGVESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 3 - protein, 3390 aa, Dengue virus type 3
  VARIANT (196)..(196): Xaa stands for Gln or His
  VARIANT (485)..(485): Xaa stands for Met or Leu
  VARIANT (671)..(671): Xaa stands for Lys or Arg
  VARIANT (1401)..(1401): Xaa stands for Glu or Asp
  VARIANT (2439)..(2439): Xaa stands for Val or Ala
  VARIANT (2894)..(2894): Xaa stands for Thr or Ala
MNNQRKKTGKPSINMLKRVRNRVSTGSQLAKRFSRGLLNGQGPMKLVMAFIAFLRFLAIPPTAGVLARWGTFKKSGAIKVLKGFKKEISNMLSIINKRKKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCNXAGEHRRDKRSVAIAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWXVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKAHNGRLITANPVVTKKEEPVNIEAEPPFGESNIVIGIGDKALKINWYXKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFGKKHMIAGVLFTFVLLLSGQITWRDMAHTLIMIGSNASDRMGMGVTYLALIATFKIQPFLALGFFLRKLTSRENLLLGVGLAMAATLRLPEDIEQMANGIALGLMALKLITQFETYQLWTALVSLTCSNTIFTLTVAWRTATLILAGISLLPVCQSSSMRKTDWLPMTVAAMGAQPLPLFIFSLKDTLKRRSWPLNEGVMAVGLVSILASSLLRNDVPMAGPLVAGGLLIACYVITGTSADLTVEKAAXVTWEEEAEQTGVSHNLMVTVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWQKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWALCEVLTLXTGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRXNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 4 - protein, 3387 aa, Dengue virus type 4
  VARIANT (1429)..(1429): Xaa stands for Ser or Phe
  VARIANT (2217)..(2217): Xaa stands for Lys or Arg
  VARIANT (2255)..(2255): Xaa stands for Phe or Leu
  VARIANT (2344)..(2344): Xaa stands for Thr or Ile
  VARIANT (2354)..(2354): Xaa stands for Phe or Leu
  VARIANT (2877)..(2877): Xaa stands for Asn or Lys
MNQRKKVVRPPFNMLKRERNRVSTPQGLVKRFSTGLFSGKGPLRMVLAFITFLRVLSIPPTAGILKRWGQLKKNKAIRILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVAIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTHFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFXIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEXQRTPQDNQLIYVILTILTIIGLIAANEMGLIEKTKTDXGFYQVKTETTILDVDLRPASAWTLYAVATTILTPMLRHTIENTSANLSLAAIANQAAVLMGLGKGWPLHRMDLGVPLLAMGCYSQVNPXTLTASLVMLXVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNVQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVVPMVTQLAMTDTTPFGQQRVFKEKVDTRTPQPKPGTRMVMTTTANWLWALLGKKKXPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 5 - protein, 3392 aa, Dengue virus type 1
  VARIANT (899)..(899): Xaa stands for Met or Ile
  VARIANT (2353)..(2353): Xaa stands for Thr or Ile
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKKKSWLVHKQWFLDLPLPWTSGASTSQETWNRQDLLVTFKTAHAKKQEVVVLGSQEGAMHTALTGATEIQTSGTTTIFAGHLKCRLRMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRNTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIXGADVQNSTFIIDGPNTPECPDDQRAWNIWEVEDYGFGIFTTNIWLKLRDSYTQLCDHRLMSAAIKDSKAVHADMGYWIESEKNETWKLARASFIEVKTCIWPKSHTLWSNGVLESEMIIPKIYGGPISQHNYRPGYFTQTVGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRKLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLXAAVLMLVAHYAIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 6 - protein, 3391 aa, Dengue virus type 2
  VARIANT (1371)..(1371): Xaa stands for Val or Ile
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVGIQEKGKSLLFKTENGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFKCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQVAGPWHLGKLEMDFDFCDGTTVIVTEDCGNRGPSLRTTTASGKLITEWCCRSCTLPPLRYRGENGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLFLTSSQQKTDWIPLALTIKGLNPTAIFLTTLSRTNKKRSWPLNEAIMAVGMVSILASSLLKNDXPMTGPLVAGGLLTVCYVLTGRSADLELERATDVKWEDQAEISGSSPILSITISEDGSMSIKNEEEEQTLTILIRTGLLVISGLFPISIPVTAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIKDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWYAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGVESEIPNLDIIGKRIEKIKQEHETSWHYDQDHPYKTWAYHGSYETKQTGSASSMVNGVVRLLTKPWDVLPTVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 7 - protein, 3390 aa, Dengue virus type 3
MNNQRKKTGKPSINMLKRVRNRVSTGSQLAKRFSRGLLNGQGPMKLVMAFIAFLRFLAIPPTAGVLARWGTFKKSGAIKVLKGFKKEISNMLSIINKRKKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLGSFVLKKEVSETQHGTILIKVEYKGKDAPCKIPFSTEDGQGKAHNGRLITANPVVTKKEEPVNIEAEPPFGESNIVIGIGDKALKINWYRKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFGKKHMIAGVLFTFVLLLSGQITWRDMAHTLIMIGSNASDRMGMGVTYLALIATFKIQPLLALGFFLRKLTSRENLLLGVGLAMAATLRLPEDIEQMANGIALGLMALKLITQFETYQLWTALVSLTCSNTIFTLTVAWRTATLILAGISLLPVCQSSSMRKTDWLPMTVAAMGAQPLPLFIFSLKDTLKRRSWPLNEGVMAVGLVSILASSLLRNDVPMAGPLVAGGLLIACYVITGTSADLTVEKAADVTWEEEAEQTGVSHNLMVTVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWKKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWALCEVLTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 8 - protein, 3387 aa, Dengue virus type 4
  VARIANT (742)..(742): Xaa stands for Val or Met
  VARIANT (1027)..(1027): Xaa stands for Gln or His
  VARIANT (1628)..(1628): Xaa stands for Val or Leu
  VARIANT (2286)..(2286): Xaa stands for Phe or Ile
  VARIANT (2482)..(2482): Xaa stands for Val or Ala
  VARIANT (2508)..(2508): Xaa stands for Tyr or Asp
MNQRKKVVRPPFNMLKRERNRVSTPQGLVKRFSTGLFSGKGPLRMVLAFITFLRVLSIPPTAGILKRWGQLKKNKAIRILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKKKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLXLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSXHNYRQGYATQTVGPWHLGKLEIDFGECPGTTVAIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTHFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGXVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLFWVAEIQPQWIAASIILEFFLMVLLIPEPEKQRTPQDNQLIYVILTILTIIGLIAANEMGLIEKTKTDFGFYQVKTETTILDVDLRPASAWTLYAVATTXLTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNXQTPRRGTGTTGETLGEKWKRQLNSLXRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVVPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 9 - protein, 3392 aa, Dengue virus type 1
  VARIANT (482)..(482): Xaa stands for Lys or Glu
  VARIANT (484)..(484): Xaa stands for Lys or Arg
  VARIANT (2357)..(2357): Xaa stands for Phe or Leu
  VARIANT (2364)..(2364): Xaa stands for Thr or Ala
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMXKXSWLVHKQWFLDLPLPWTSGASTSQETWNRQDLLVTFKTAHAKKQEVVVLGSQEGAMHTALTGATEIQTSGTTTIFAGHLKCRLRMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRNTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNSTFIIDGPNTPECPDDQRAWNIWEVEDYGFGIFTTNIWLKLRDSYTQLCDHRLMSAAIKDSKAVHADMGYWIESEKNETWKLARASFIEVKTCIWPKSHTLWSNGVLESEMIIPKIYGGPISQHNYRPGYFTQTVGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRKLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVXMLVAHYXIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 10 - protein, 3391 aa, Dengue virus type 2
  VARIANT (1461)..(1461): Xaa stands for Val or Ala
  VARIANT (2190)..(2190): Xaa stands for Tyr or Cys
  VARIANT (2347)..(2347): Xaa stands for Leu or Pro
  VARIANT (2828)..(2828): Xaa stands for Thr or Met
  VARIANT (3020)..(3020): Xaa stands for Thr or Ala
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVGIQEKGKSLLFKTENGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLKEEQDKRFVCKHSMVDRGWGNGCGLFGKGGIVTCAMFKCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADKQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQVAGPWHLGKLEMDFDFCDGTTVIVTEDCGNRGPSLRTTTASGKLITEWCCRSCTLPPLRYRGENGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLFLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPXTAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIKDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWXAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNXITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGVESEIPNLDIIGKRIEKIKQEHETSWHYDQDHPYKTWAYHGSYETKQTGSASSMVNGVVRLLTKPWDVLPXVTQMAMTDTTPFGQQRVFKEKVDTRTQEPKEGTKKLMRITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGXMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 11 - protein, 3390 aa, Dengue virus type 3
  VARIANT (764)..(764): Xaa stands for Thr or Ile
MNNQRKKTGKPSINMLKRVRNRVSTGSQLAKRFSRGLLNGQGPMKLVMAFIAFLRFLAIPPTAGVLARWGTFKKSGAIKVLKGFKKEISNMLSIINKRKKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLGSFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGVRRMAILGDTAWDFGSVGGVLNSLGKMVHQIFGSAYTALFGGVSWMMKIGIGVLLTWIGLNSKNTSMSFSCIAIGIIXLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDITGVLEQGKRTLTPQPMELKYSWKTWGKAKIVTAETQNSSFIIDGPSTPECPSASRAWNVWEVEDYGFGVFTTNIWLKLREVYTQLCDHRLMSAAVKDERAVHADMGYWIESQKNGSWKLEKASFIEVKTCTWPKSHTLWSNGVLESDMIIPKSLAGPISQHNHRPGYHTQTAGPWHLGKLELDFNYCEGTTVVISENCGTRGPSLRTTTVSGKLIHEWCCRSCTLPPLRYMGEDGCWYGMEIRPINEKEENMVKSLASAGSGKVDNFTMGVLCLAILFEEVMRGKFGKKHMIAGVLFTFVLLLSGQITWRDMAHTLIMIGSNASDRMGMGVTYLALIATFKIQPLLALGFFLRKLTSRENLLLGVGLAMATTLRLPEDIEQMANGIALGLMALKLITQFETYQLWTALVSLTCSNTIFTLTVAWRTATLILAGISLLPVCQSSSMRKTDWLPMTVAAMGAQPLPLFIFSLKDTLKRRSWPLNEGVMAVGLVSILASSLLRNDVPMAGPLVAGGLLIACYVITGTSADLTVEKAADVTWEEEAEQTGVSHNLMVTVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTHNGKRLEPNWASVKKDLISYGGGWRLSAQWKKGEEVQVIAVEPGKNPKNFQTMPGIFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFVGKTVWFVPSIKAGNDIANCLRKNGKKVIQLSRKTFDTEYQKTKLNDWDFVVTTDISEMGANFKADRVIDPRRCLKPVILTDGPERVILAGPMPVTVASAAQRRGRVGRNPQKENDQYIFMGQPLNNDEDHAHWTEAKMLLDNINTPEGIIPALFEPEREKSAAIDGEYRLKGESRKTFVELMRRGDLPVWLAHKVASEGIKYTDRKWCFDGERNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMADVPLQWIASAIVLEFFMMVLLIPEPEKQRTPQDNQLAYVVIGILTLAAIVAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLAAAVLLLVTHYAIIGPGLQAKATREAQKRTAAGIMKNPTVDGIMTIDLDPVIYDSKFEKQLGQVMLLVLCAVQLLLMRTSWALCEVLTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVSSVNMVSRLLLNRFTMTHRRPTIEKDVDLGAGTRHVNAEPETPNMDVIGERIKRIKEEHSSTWHYDDENPYKTWAYHGSYEVKATGSASSMINGVVKLLTKPWDVVPMVTQMAMTDTTPFGQQRVFKEKVDTRTPRPMPGTRKVMEITAEWLWRTLGRNKRPRLCTREEFTKKVRTNAAMGAVFTEENQWDSARAAVEDEEFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPKGTVMDIISRKDQRGSGQVGTYGLNTFTNMEAQLIRQMEGEGVLSKADLENPHPLEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWALMYFHRRDLRLASNAICSAVPVHWVPTSRTTWSIHAHHQWMTTEDMLTVWNRVWIEDNPWMEDKTPVTTWEDVPYLGKREDQWCGSLIGLTSRATWAQNILTAIQQVRSLIGNEEFLDYMPSMKRFRKEEESEGAIW

SEQ ID NO: 12 - protein, 3387 aa, Dengue virus type 4
MNQRKKVVRPPFNMLKRERNRVSTPQGLVKRFSTGLFSGKGPLRMVLAFITFLRVLSIPPTAGILKRWGQLKKNKAIRILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSHHNYRQGYATQTVGPWHLGKLEIDFGECPGTTVAIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTHFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLFWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNVQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVVPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 13 - protein, 3392 aa, Dengue virus type 1
  VARIANT (482)..(482): Xaa stands for Lys or Glu
  VARIANT (484)..(484): Xaa stands for Lys or Arg
  VARIANT (2364)..(2364): Xaa stands for Thr or Ala
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMXKXSWLVHKQWFLDLPLPWTSGASTSQETWNRQDLLVTFKTAHAKKQEVVVLGSQEGAMHTALTGATEIQTSGTTTIFAGHLKCRLRMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRNTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNSTFIIDGPNTPECPDDQRAWNIWEVEDYGFGIFTTNIWLKLRDSYTQLCDHRLMSAAIKDSKAVHADMGYWIESEKNETWKLARASFIEVKTCIWPKSHTLWSNGVLESEMIIPKIYGGPISQHNYRPGYFTQTVGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRKLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYXIIGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 14 - protein, 3391 aa, Dengue virus type 2
  VARIANT (363)..(363): Xaa stands for Lys or Glu
  VARIANT (506)..(506): Xaa stands for Lys or Glu
  VARIANT (2190)..(2190): Xaa stands for Tyr or Cys
  VARIANT (2347)..(2347): Xaa stands for Leu or Pro
  VARIANT (2351)..(2351): Xaa stands for Thr or Ile
  VARIANT (2828)..(2828): Xaa stands for Thr or Met
  VARIANT (2894)..(2894): Xaa stands for Val or Gly
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVGIQEKGKSLLFKTENGVNMCTLMAMDLGELCEDTITYKCPLLRQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLXEEQDKRFVCKHSMVDRGWGNGCGLFGKGGIVTCAMFKCKKNMEGKIVQPENLEYTIVVTPHSGEEHAVGNDTGKHGKEIKVTPQSSITEAELTGYGTVTMECSPRTGLDFNEMVLLQMENKAWLVHRQWFLDLPLPWLPGADXQESNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRYVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFITDNVHTWTEQYKFQPESPSKLASAIQKAQEEGICGIRSVTRLENLMWKQITPELNHILAENEVKLTIMTGDIKGIMQAGKRSLRPQPTELKYSWKTWGKAKMLSTESYNQTFLIDGPETAECPNTNRAWNSLEVEDYGFGVFTTNIWLKLKEKQDAFCDSKLMSAAIKDNRAVHADMGYWIESALNDTWKIEKASFIEVKNCHWPKSHTLWSNGVLESEMIIPKNLAGPVSQHNYRPGYHTQVAGPWHLGKLEMDFDFCDGTTVIVTEDCGNRGPSLRTTTASGKLITEWCCRSCTLPPLRYRGENGCWYGMEIRPLKEKEENLVNSLVTAGHGQVDNFSLGVLGMALFLEEMLRTRVGTKHAILLVAVSFVTLITGNMSFKDLGRVVVMVGATMADDIGMGVTYLALLAAFKVRPTFAAGLLLRKLTSKELMMTTIGIVLLSQSTIPETVLELTDALALGMMVLKIVRNMEKYQLAVTIMAILCVPNAVILQNAWKVSCTILAVVSVSPLFLTSSQQKTDWIPLALTIKGLNPTAIFLTTLSRTNKKRSWPLNEAIMAVGMVSILASSLLKNDIPMTGPLVAGGLLTVCYVLTGRSADLELERATDVKWEDQAEISGSSPILSITISEDGSMSIKNEEEEQTLTILIRTGLLVISGLFPISIPVTAAAWYLWEVKKQRAGVLWDVPSPPPMGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFKTNTGTIGAVSLDFSPGTSGSPIIDKKGKVVGLYGNGVVTRSGAYVSAIAQTEKSIEDNPEIKDDIFRKRRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIIDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKTRDALDNLAVLHTAEAGGRAYNHALSELPETLETLLLLTLLATVTGGIFLFLMSGRGIGKMTLGMCCIITASILLWXAQIQPHWIAASIILEFFLIVLLIPEPEKQRTPQDNQLTYVVIAILTVVAATMANEMGFLEKTKKDLGLGSIATQQPESNILDIDLRPASAWTLYAVATTFVTPMLRHSIENSSVNVSLTAIANQATVLMGLGKGWPLSKMDIGVPLLAIGCYSQVNXITLXAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNTRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFIPPEKCDTLLCDIGESSPNPTVEAGRTLRVLNLVENWLNNNTQFCIKVLNPYMPSVIEKMEALQRKYGGALVRNPLSRNSTHEMYWVSNASGNIVSSVNMISRMLINRFTMRHKKATYEPDVDLGSGTRNIGVESEIPNLDIIGKRIEKIKQEHETSWHYDQDHPYKTWAYHGSYETKQTGSASSMVNGVVRLLTKPWDVLPXVTQMAMTDTTPFGQQRVFKEKVDTRTQEPKEGTKKLMRITAEWLWKELGKKKTPRMCTREEFTRKXRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMEGEHKKLAEAIFKLTYQNKVVRVQRPTPRGTVMDIISRRDQRGSGQVGTYGLNTFTNMEAQLIRQMEGEGVFKNIQHLTVTEEVAVQNWLARVGRERLSRMAISGDDCVVKPLDDRFANALTALNDMGKIRKDIQQWEPSKGWNDWTQVPFCSHHFHELIMKDGRVLVVPCRNQDELIGRARISQGAGWSLRETACLGKSYAQMWSLMYFHRRDLRLAANAICSAVPSHWVPTSRTTWSIHAKHEWMTTEDMLTVWNRVWIRENPWMEDKTPVESWEEIPYLGKREDQWCGSLIGLTSRATWAKNIQAAINQVRSLIGNEEYTDYMPSMKRFRREEEEAGVLW

SEQ ID NO: 15 - protein, 3390 aa, Dengue virus type 3; identical to SEQ ID NO: 11
  VARIANT (764)..(764): Xaa stands for Thr or Ile

SEQ ID NO: 16 - protein, 3387 aa, Dengue virus type 4
  VARIANT (521)..(521): Xaa stands for Val or Leu
  VARIANT (1396)..(1396): Xaa stands for Ser or Leu
  VARIANT (1506)..(1506): Xaa stands for Gly or Trp
MNQRKKVVRPPFNMLKRERNRVSTPQGLVKRFSTGLFSGKGPLRMVLAFITFLRVLSIPPTAGILKRWGQLKKNKAIRILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKXPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGKELKCGSGIFVVDNVHTWTEQYKFQPESPARLASAILNAHKDGVCGIRSTTRLENVMWKQITNELNYVLWEGGHDLTVVAGDVKGVLTKGKRALTPPVNDLKYSWKTWGKAKIFTPEARNSTFLIDGPDTSECPNERRAWNFLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSHHNYRQGYATQTVGPWHLGKLEIDFGECPGTTVAIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILVVVITLCAIILGGLTWMDLLRALIMLGDTMSGRIGGQIHLAIMAVFKMSPGYVLGVFLRKLTSRETALMVIGMAMTTVLSIPHDLMELIDGISLGLILLKIVTHFDNTQVGTLALSLTFIRSTMPLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLXLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFXKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLFWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLSVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNVQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVVPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLKECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMTDKTPVHSWEDIPYLGKREDLWCGSLIGLSSRATWAKNIHTAITQVRNLIGKEEYVDYMPVMKRYSAPSESEGVL

SEQ ID NO: 17 - DNA, 10176 bp, Dengue virus type 1
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcragcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacctcgggagcctcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggaacacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaagaaaatgattaggccacaacccatggaacacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaattgtgtgaccaccggctaatgtcagctgccatcaaggacagcaaggcagttcacgctgacatggggtactggatagaaagtgaaaagaacgagacctggaagctggcaagagcctcgttcatagaagttaaaacatgtrtttggccaaaatcccacactctatggagcaacggagttctggaaagtgaaatgataattccaaagatctatggaggaccaatatctcagcataactacagaccaggatatttcacacaaacggtagggccgtggcacctaggcaagttggaactggattttgacttgtgtgagggtaccacagtcgttgtggatgaacattgtggaaatcgaggaccatctcttaggaccacaacagtcacaggaaagataattcatgaatggtgttgtagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtaatgagatccagatggagtagaaaaatgctgatgactggaacactggctgtgttcctccttctcataatgggacaattgacatggaatgatctgatcagattatgcatcatggttggagccaacgcttccgatagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagttggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatcccccatcgtgaacagagaaggaaaaatagtaggtctttatggaaatggagtagtgacaacaagtggaacctacgtyagtgccatagctcaagccaaagcatcacaagaagggcccctaccagagattgaagacgaagtgtttaggaaaagaaacttaacaattatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcactgatccatccagcatagcggccagagggtacatctcaacccgagtgggcatgggtgaagcagctgcgattttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgggtgattcaattgagcaggaaaacctttgatacagagtaccaaaaaacaaaaaataacgactgggattatgtcgtcacaacagacatctccgaaatgggagcaaatttccgggccgacagggtgatagacccaagacggtgtctgaaaccggtaatactaaaagatggtccagagcgtgtcattctagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgayagcagcggtgttgatgctagyggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggcccacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggttcagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagtggagatgactgcgtagtgaaaccaattgatgacaggttcgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtatggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctgg

SEQ ID NO: 18 - DNA, 10173 bp, Dengue virus type 2
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtagctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaaatgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtgggttatttggaaagggaggcattgtgacctgtgctawgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagctgaattgacaggttatggcaccgtcacgatggagtgctccccgagaacaggcctcgacttcaatgagatggtgttgctgcagatggaaaataragcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatctttgcggcctcagcccactgagctaaagtattcatggaaaacatggggtaaagcaaaaatgctctctacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataatcccaaagaatctcgctggaccagtgtctcaacacaactatagaccaggctaccatacacaagtagcaggaccatggcacctaggtaagcttgagatggactttgatttctgcgatggaaccacagtaatagtgactgaggactgcggaaatagaggaccctctttgagaacaactactgcctctggaaaactcataacggaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgacgcgttagccttaggcatgatggtccttaaaatagtaagaaacatggaaaagtatcaattagcagtgactatcatggctatcttgtgcgtcccaaacgcagtgatattgcaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccagtcacggcagcagcatggtacctgtgggaagtgaagaaacaacgggccggagtattgtgggacgttccttcacctccacccatgggaaaggctgaactggaagatggagcctacagaatcaagcaaaaagggattcttgggtattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctcttagaggacttccaataagataccaaaccccagccatcagagctgagcacaccgggcgggaaattgtggatctaatgtgtcatgccacatttaccatgaggctgctgtcaccagttagagtgccaaactataacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagcgcagcacaaagaagagggagaataggaagaaatccaaaaaatgaaaatgaccagtacatatacatgggagaacctttggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaggaattcaaagaatttgcagccggaagaaagtctctgaccctgaacctaatcacagaaatgggtaggcttccaacattcatgactcagaagacgagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaratacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcatagcagctctcctcttattggtagcgcattacgccatcattgggccaggacttcaagcaaaagcaaccagagaagcccagaaaagagcagcggcgggcatcatgaaaaacccaaccgtcgatggaataacagtgattgatctagatccaataccttatgatccaaagttygaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacctggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaggtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcattccgccagaaaagtgtgacacattgttgtgtgacataggggagtcatcaccaaatcccacagtggaagcaggacgaacactcagagtccttaacttagtagaaaactggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacctacgagccggatgttgacctcggaagcggaacccgaaacattggagttgaaagtgaaataccaaacctagacataattgggaaaagaatagaaaaaataaagcaagagcatgaaacatcatggcactacgaccaagaccacccatayaaaacgtgggcataccatggtagctatgaaacaaaacagactggatcagcatcatccatggtcaacggagtggtcaggctgctgacaaaaccttgggacgttctccccacggtgacacagatggcaatgacagacacgactccatttggacaacagcgtgtttttaaagaaaaagtggacacgagaacccaagaaccgaaagaaggcacgaagaaactaatgagaatcacagcagagtggctgtggaaagaattagggaagaaaaagacacctaggatgtgcaccagagaagaattcacaagaaaggtgagaagcaatgcagccttgggggccatattcactgatgagaacaagtggaartcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacatatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccytcaaaaggatggaacgattggacacaagtgcccttctgttcacaccatttccatgagctaatcatgaaggatggtcgtgtacttgttgttccatgtagaaaccaagatgaattgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagatttagaagagaagaggaagaagcaggagtcctgtgg

SEQ ID NO: 19 - DNA, 10170 bp, Dengue virus type 3
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcatttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcawgctggagagcatagacgcgataagagatcagtggcgatagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacaygagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggwtggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttragtagctttgtgttgaagaaagaagtctccgaaacgcagcatgggacaatactcattaaggttgagtacaaaggggaagatgcaccctgcaagattcctttctccacggaggatggacaaggaaaagctcacaatggcagactgatcacagccaatccagtggtgaccaagaaggaggagcctgtcaacattgaggctgaacctccttttggagaaagtaacatagtaattggaattggagacaaagccctgaaaatcaactggtacargaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaagagactggcaacagccattgcaggcgcttgggaaaatggagtgtgcggaattaggtcaacaaccagaatggagaacctcttgtggaagcaaatagccaatgaactgaattacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaggattacgggttcggagttttcacaaccaacatatggctgaaactccgagaggtgtacacccaactatgtgaccataggctaatgtcggcagccgtcaaggatgagagggctgtacatgccgacatgggctattggatagaaagccaaaagaatgggagttggaagctagaaaaagcatccttcatagaggtgaaaacctgcacatggccaaaatcacacactctctggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacggtgtcagggaagttgatacacgaatggtgctgccgctcgtgcacacttcctcccctacgatacatgggagaagacggctgctggtatggcatggaaatcagacccattaatgagaaagaagagaatatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccattcctggctttgggattcttcctgaggaaactgacatctagagaaaatttattgctgggagttgggttggccatggcagcaacgttacgactgccagaggacattgaacagatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagctcaacccctaccactttttattttcagtctgaaagatacactcaaaaggagaagctggccactgaatgagggggtgatggcagttggacttgtgagcattctagctagttctctccttaggaatgatgtgcctatggctggaccattagtggctgggggcttgctgatagcgtgctacgtcataactggcacgtcagcagacctcactgtagaaaaagcagcagawgtaacatgggaggaagaggccgagcaaacaggagtgtcccacaatttaatggtcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcatgtcacaagaggggcagtgttgacacacaatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatctccatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggttattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaagaattcaaggattttgcagctggcagaaagtcaatcgcccttgatcttgtgacagaaataggaagagtgccttcacacttagcccacagaacgagaaacgccctggataatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcatcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtctctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccacccgtgaagctcagaaaaggacagctgctggaataatgaagaatccaacggtggatggaataatgacaatagacctagatcctgtaatatatgattcaaaatttgaaaagcaactaggacaggtcatgctcctggttctgtgtgcagtccaacttttattgatgagaacatcatgggccttgtgtgaagttctaaccctagycacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcctgaaggaagagtcatagacctaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagttttgaagatggttgaaccatggctaaagaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaatatcgtctcttcagtcaacatggtatccagattgctactgaacagattcacaatgacacacaggagacccaccatagagaaagatgtggatctaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccattcggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggaattcacaaagaaggtcagarccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagcyggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggaaaggttaaaaagaatggccatcagcggggatgattgcgttgtgaaaccaatcgacgacagattcgccaatgccctgcttgccctgaacgatatgggaaaggttagaaaggacatacctcaatggcagccatcaaagggatggcatgattggcaacaggtccccttctgctcccaccactttcatgaattgatcatgaaagatggaagaaagttggtagttccctgcagaccccaggacgaactaataggaagagcgagaatctcccaaggagcaggatggagccttagagaaactgcatgtctagggaaagcctacgctcaaatgtgggctctcatgtattttcacagaagagatcttagactagcatccaacgccatatgttcagcagtaccagtccactgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttgg

SEQ ID NO: 20 - DNA, 10161 bp, Dengue virus type 4
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaaaagatggggacagttgaagaaaaataaggccatcaggatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccytggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccggagtccccagcgagactagcgtctgcaatattgaatgcccacaaagatggggtctgtggaattagatcaaccacgaggctggaaaatgtcatgtggaagcaaataaccaacgagctaaattatgttctctgggaaggaggacatgacctcactgtagtggctggggatgtgaagggggtgttgaccaaaggcaagagagcactcacacccccagtgaatgatctgaaatattcatggaagacatggggaaaagcaaaaatcttcaccccagaagcaagaaatagcacatttttaatagacggaccagacacctccgaatgccccaatgaacgaagagcatggaactttcttgaggtggaagactatggatttggcatgttcacgaccaacatatggatgaaattccgagaaggaagttcagaagtgtgtgaccacaggttaatgtcagcggcaattaaagatcagaaagctgtgcatgctgacatgggttattggatagagagctcaaaaaaccagacctggcagatagagaaagcatctcttattgaagtgaaaacatgtctgtggcccaagacccacacattgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcgcaattcaggaggattgtgaccatagaggcccatctttgaggaccaccactgcatctggaaaactagtcacgcaatggtgctgccgctcctgcacgatgcctcccttaaggttcttgggwgaagatgggtgctggtatgggatggagattaggcccttgagtgaaaaagaagagaacatggtcaaatcacaggtaacggccggacagggcacatcagaaactttttctatgggtctgttgtgcctgaccttgtttgtggaagaatgcttgaggagaagagtcactaggaaacacatgatattggttgtggtgatcactctttgtgccatcatcctaggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactggggctaattttgctaaaaatagtgacacattttgacaacacccaagtgggaaccttagccctttccttgaccttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctycatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttgggaaaactcaggttggagtagggatacacatggaaggtgtatttcacacaatgtggcatgtaacaagaggatcagtgatctgccatgagactgggagattggagccatcttgggctgacgtcaggaatgacatgatatcatacggtgggggatggagacttggagacaaatgggacaaagaagaagatgttcaggtcctcgccatagaaccaggaaaaaatcctaaacatgtccaaacgaaacccggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaaccttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagagttccaaattacaacctcatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctaggagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaaggaataaccaaattttagaagaaaacatggaggttgaaatttggactagagagggagaaaagaaaaagctaaggccaagatggttagatgcacgtgtatacgctgaccccatggctttgaaggattttaaggagtttgctagtggaaggaagagcataactctcgacatcctaacagagattgccagtttgccaacttacctttcctctagggccaagctcgcccttgataacatagtcatgctccacacaacagaaagaggagggagggcctaccaacacgccctgaacgaactcccggagtcactggaaacacttatgcttgtagctttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaracaaaggaccccacaagacaatcaattgatctacgtcatattgaccattctcaccattattggtctcatagcagccaacgagatggggctgattgaaaaaacaaaaacggatyttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcggccgtcctaatggggcttggaaaaggatggccgctccacagaatggacctcggtgtgccgctgttagcaatgggatgctattctcaagtgaacccaayaactttgacagcatccttagtcatgcttttwgtccattatgcaataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaggtcatgctactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacctggcgggagctggactggctttttcactcataaagaatgtacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagattagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaggagcacaaagaaacctggcattatgatcaggaaaacccatacagaacctgggcgtatcatggaagctatgaagctccttcgacaggctctgcatcctccatggtgaacggggtagtaaaactgctaacaaaaccttgggatgtggttccaatggtgacccagttagccatgacagacacaaccccttttgggcaacaaagagtgttcaaagagaaggtggataccagaacaccacaaccaaaacccggtacacgaatggttatgaccacgacagccaattggctgtgggccctccttgggaagaagaaaaawcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaagaactgatcacggaacagatggccccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctggatgagaggtttggcacttccctcctcttcttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatatgctcagcagttccaacggaatggtttccaacaagcagaacaacatggtcaatccacgctcatcatcagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcagaaacctgatcggaaaagaggaatacgtggattacatgccagtaatgaaaagatacagcgctccttcagagagtgaaggagttctg

SEQ ID NO: 21 - DNA, 10176 bp, Dengue virus type 1
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaaaaaaaatcatggctagtccacaaacaatggtttctagacttaccactgccttggacctcgggagcctcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaggatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggaacacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaagaaaatgattaggccacaacccatggaacacaaatactcgtggaaaagctggggaaaggctaaaatcatrggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaattgtgtgaccaccggctaatgtcagctgccatcaaggacagcaaggcagttcacgctgacatggggtactggatagaaagtgaaaagaacgagacctggaagctggcaagagcctcgttcatagaagttaaaacatgtatttggccaaaatcccacactctatggagcaacggagttctggaaagtgaaatgataattccaaagatctatggaggaccaatatctcagcataactacagaccaggatatttcacacaaacggtagggccgtggcacctaggcaagttggaactggattttgacttgtgtgagggtaccacagtcgttgtggatgaacattgtggaaatcgaggaccatctcttaggaccacaacagtcacaggaaagataattcatgaatggtgttgtagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtaatgagatccagatggagtagaaaaatgctgatgactggaacactggctgtgttcctccttctcataatgggacaattgacatggaatgatctgatcagattatgcatcatggttggagccaacgcttccgatagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagttggcccctcaatgaagggatcatggctgttggaatagtcagcatcctactaagttcactcctcaagaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatcccccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaaattaacaattatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcactgatccatccagcatagcggccagagggtacatctcaacccgagtgggcatgggtgaagcagctgcgattttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgggtgattcaattgagcaggaaaacctttgatacagagtaccaaaaaacaaaaaataacgactgggattatgtcgtcacaacagacatctccgaaatgggagcaaatttccgggccgacagggtgatagacccaagacggtgtctgaaaccggtaatactaaaagatggtccagagcgtgtcattctagcaggaccgatgccagtgactgtggccagtgccgcccagaggagaggaagaattggaaggaaccacaataaggaaggtgaccagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccaytgacgctgayagcagcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggcccacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggttcagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagtggagatgactgcgtagtgaaaccaattgatgacaggttcgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtatggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctgg

SEQ ID NO: 22 - DNA, 10173 bp, Dengue virus type 2
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtagctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtctgcaggcatgatcattatgctgattccaacagtgatggcgttccatctaaccacacgcaacggagaaccacacatgatcgtcggtatacaggagaaagggaaaagtcttctgttcaaaacagagaatggtgtgaacatgtgcaccctcatggctatggaccttggtgaattgtgtgaagacacaatcacgtacaaatgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtgggttatttggaaagggaggcattgtgacctgtgctatgttcaaatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagctgaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatctttgcggcctcagcccactgagctaaagtattcatggaaaacatggggtaaagcaaaaatgctctctacagaatcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataatcccaaagaatctcgctggaccagtgtctcaacacaactatagaccaggctaccatacacaagtagcaggaccatggcacctaggtaagcttgagatggactttgatttctgcgatggaaccacagtaatagtgactgaggactgcggaaatagaggaccctctttgagaacaactactgcctctggaaaactcataacggaatggtgctgccgatcttgcacattaccacccctaagatacagaggtgagaatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgacgcgttagccttaggcatgatggtccttaaaatagtaagaaacatggaaaagtatcaattagcagtgactatcatggctatcttgtgcgtcccaaacgcagtgatattgcaaaatgcatggaaagtgagttgcacaatactggcagtggtgtccgtttccccactgtttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatrttcccatgacaggaccactagtggctggagggctcctcactgtgtgctacgtgctcactggacgatcggccgacttggaactggagagagcaaccgaygtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccagtcacggcagcagcatggtacctgtgggaagtgaagaaacaacgggccggagtattgtgggacgttccttcacctccacccatgggaaaggctgaactggaagatggagcctacagaatcaagcaaaaagggattcttgggtattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcaaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctcttagaggacttccaataagataccaaaccccagccatcagagctgagcacaccgggcgggaaattgtggatctaatgtgtcatgccacatttaccatgaggctgctgtcaccagttagagtgccaaactataacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagcgcagcacaaagaagagggagaataggaagaaatccaaaaaatgaaaatgaccagtacatatacatgggagaacctttggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaggaattcaaagaatttgcagccggaagaaagtctctgaccctgaacctaatcacagaaatgggtaggcttccaacattcatgactcagaagacgagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactcttacagcagctctcctcttattggtagcgcattacgccatcattgggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacctggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaggtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcattccgccagaaaagtgtgacacattgttgtgtgacataggggagtcatcaccaaatcccacagtggaagcaggacgaacactcagagtccttaacttagtagaaaactggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacctacgagccggatgttgacctcggaagcggaacccgaaacattggagttgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgttctccccacggtgacacagatggcaatgacagacacgactccatttggacaacagcgtgtttttaaagaaaaagtggacacgagaacccaagaaccgaaagaaggcacgaagaaactaatgagaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacatatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaattgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagatttagaagagaagaggaagaagcaggagtcctgtgg

SEQ ID NO: 23 - DNA, 10170 bp, Dengue virus type 3
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcatttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaagggatgagctatgcaatgtgcttgggtagctttgtgttgaagaaagaagtctccgaaacgcagcatgggacaatactcattaaggttgagtacaaagggaaagatgcaccctgcaagattcctttctccacggaggatggacaaggaaaagctcacaatggcagactgatcacagccaatccagtggtgaccaagaaggaggagcctgtcaacattgaggctgaacctccttttggagaaagtaacatagtaattggaattggagacaaagccctgaaaatcaactggtacaggaagggaagctcgattgggaagatgttcgaggctactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaagagactggcaacagccattgcaggcgcttgggaaaatggagtgtgcggaattaggtcaacaaccagaatggagaacctcttgtggaagcaaatagccaatgaactgaattacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaggattacgggttcggagttttcacaaccaacatatggctgaaactccgagaggtgtacacccaactatgtgaccataggctaatgtcggcagccgtcaaggatgagagggctgtacatgccgacatgggctattggatagaaagccaaaagaatgggagttggaagctagaaaaagcatccttcatagaggtgaaaacctgcacatggccaaaatcacacactctctggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacggtgtcagggaagttgatacacgaatggtgctgccgctcgtgcacacttcctcccctacgatacatgggagaagacggctgctggtatggcatggaaatcagacccattaatgagaaagaagagaatatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccactcctggctttgggattcttcctgaggaaactgacatctagagaaaatttattgctgggagttgggttggccatggcagcaacgttacgactgccagaggacattgaacagatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagctcaacccctaccactttttattttcagtctgaaagatacactcaaaaggagaagctggccactgaatgagggggtgatggcagttggacttgtgagcattctagctagttctctccttaggaatgatgtgcctatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatggtcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcatgtcacaagaggggcagtgttgacacacaatgggaaaagactggaaccaaactgggctagcgtgaaaaaagatctgatttcatacggaggaggatggagattgagtgcacaatggaaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatctccatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggttattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaagaattcaaggattttgcagctggcagaaagtcaatcgcccttgatcttgtgacagaaataggaagagtgccttcacacttagcccacagaacgagaaacgccctggataatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcatcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtctctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccacccgtgaagctcagaaaaggacagctgctggaataatgaagaatccaacggtggatggaataatgacaatagacctagatcctgtaatatatgattcaaaatttgaaaagcaactaggacaggtcatgctcctggttctgtgtgcagtccaacttttattgatgagaacatcatgggccttgtgtgaagttctaaccctagccacaggaccaataacaacactctgggaaggatcacctgggaagttctggaacaccacgatagctgtttccatggcgaacatctttagagggagctatttagcaggagctgggctwgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcctgaaggaagagtcatagacctaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagttttgaagatggttgaaccatggctaaagaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaatatcgtctcttcagtcaacatggtatccagattgctactgaacagattcacaatgacacacaggagacccaccatagagaaagatgtggatctaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccattcggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggaattcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggaaaggttaaaaagaatggccatcagcggggatgattgcgttgtgaaaccaatcgacgacagattcgccaatgccctgcttgccctgaacgatatgggaaaggttagaaaggacatacctcaatggcagccatcaaagggatggcatgattggcaacaggtccccttctgctcccaccactttcatgaattgatcatgaaagatggaagaaagttggtagttccctgcagaccccaggacgaactaataggaagagcgagaatctcccaaggagcaggatggagccttagagaaactgcatgtctagggaaagcctacgctcaaatgtgggctctcatgtattttcacagaagagatcttagactagcatccaacgccatatgttcagcagtaccagtccactgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttgg

SEQ ID NO: 24 - DNA, 10161 bp, Dengue virus type 4
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaaaagatggggacagttgaagaaaaataaggccatcaggatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacrtggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctrggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaagaaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctartgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccggagtccccagcgagactagcgtctgcaatattgaatgcccacaaagatggggtctgtggaattagatcaaccacgaggctggaaaatgtcatgtggaagcaaataaccaacgagctaaattatgttctctgggaaggaggacatgacctcactgtagtggctggggatgtgaagggggtgttgaccaaaggcaagagagcactcacacccccagtgaatgatctgaaatattcatggaagacatggggaaaagcaaaaatcttcaccccagaagcaagaaatagcacatttttaatagacggaccagacacctccgaatgccccaatgaacgaagagcatggaactttcttgaggtggaagactatggatttggcatgttcacgaccaacatatggatgaaattccgagaaggaagttcagaagtgtgtgaccacaggttaatgtcagcggcaattaaagatcagaaagctgtgcatgctgacatgggttattggatagagagctcaaaaaaccagacctggcagatagagaaagcatctcttattgaagtgaaaacatgtctgtggcccaagacccacacattgtggagcaatggagtgctggaaagccagatgctcattccaaaatcatatgcgggccctttttcacascacaattaccgccagggctatgccacgcaaaccgtgggcccatggcacttaggcaaattagagatagactttggagaatgccccggaacaacagtcgcaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtaacggccggacagggcacatcagaaactttttctatgggtctgttgtgcctgaccttgtttgtggaagaatgcttgaggagaagagtcactaggaaacacatgatattggttgtggtgatcactctttgtgccatcatcctaggaggcctcacatggatggacttaytacgagccctcatcatgttgggggacactatgtctggtagaataggaggacagatccacctagccatcatggcagtgttcaagatgtcaccaggataygtgctgggtgtgtttttaaggaaactcacttcaagagagacagcactaatggtaataggaatggccatgacaacggtgctttcaattccacatgaccttatggaactcattgatggaatatcactggggctaattttgctaaaaatagtgacacattttgacaacacccaagtgggaaccttagccctttccttgaccttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttgggaaaactcaggttggagtagggatacacatggaaggtgtatttcacacaatgtggcatgtaacaagaggatcagtgatctgccatgagactgggagattggagccatcttgggctgacgtcaggaatgacatgatatcatacggtgggggatggagacttggagacaaatgggacaaagaagaagatgttcaggtcctcgccatagaaccaggaaaaaatcctaaacatgtccaaacgaaacccggccttttcaagaccctaactggagaaattggagcagtaacattagatttcaaacccggaacgtctggttctcccatcatcaacaggaaaggaaaagtcatcggactctatggaaatggaktagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaaccttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagagttccaaattacaacctcatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctaggagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaaggaataaccaaattttagaagaaaacatggaggttgaaatttggactagagagggagaaaagaaaaagctaaggccaagatggttagatgcacgtgtatacgctgaccccatggctttgaaggattttaaggagtttgctagtggaaggaagagcataactctcgacatcctaacagagattgccagtttgccaacttacctttcctctagggccaagctcgcccttgataacatagtcatgctccacacaacagaaagaggagggagggcctaccaacacgccctgaacgaactcccggagtcactggaaacacttatgcttgtagctttactaggtgctatgacagcaggtatcttcctgtttttcatgcaagggaaaggaatagggaaattgtcaatgggtttgataaccattgcggtggctagtggcttgttctgggtagcagaaattcaaccccagtggatagcggcctcaatcatactagagttttttctcatggtactgttgataccggaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggacttgagaccagcttcagcatggacgctctatgcagtagccaccacawttctgactcccatgctgagacacaccatagaaaacacgtcggccaacctatctctagcagccattgccaaccaggcggccgtcctaatggggcttggaaaaggatggccgctccacagaatggacctcggtgtgccgctgttagcaatgggatgctattctcaagtgaacccaacaactttgacagcatccttagtcatgctttcagtccattatgcaataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaggtcatgctactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacctggcgggagctggactggctttttcactcataaagaatgyacaaacccctaggaggggaactgggaccacaggagagacactgggagagaagtggaagagacagctaaactcattakacagaaaagagtttgaagagtataaaagaagtggaatactagaagtggacaggactgaagccaagtctgccctgaaagatgggtctaaaatcaagcatgcagtatctagagggtccagtaagattagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaggagcacaaagaaacctggcattatgatcaggaaaacccatacagaacctgggcgtatcatggaagctatgaagctccttcgacaggctctgcatcctccatggtgaacggggtagtaaaactgctaacaaaaccttgggatgtggttccaatggtgacccagttagccatgacagacacaaccccttttgggcaacaaagagtgttcaaagagaaggtggataccagaacaccacaaccaaaacccggtacacgaatggttatgaccacgacagccaattggctgtgggccctccttgggaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaagaactgatcacggaacagatggccccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctggatgagaggtttggcacttccctcctcttcttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatatgctcagcagttccaacggaatggtttccaacaagcagaacaacatggtcaatccacgctcatcatcagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcagaaacctgatcggaaaagaggaatacgtggattacatgccagtaatgaaaagatacagcgctccttcagagagtgaaggagttctg

SEQ ID NO: 25 - DNA, 10176 bp, Dengue virus type 1
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtyaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgraaaaaaratcatggctagtccacaaacaatggtttctagacttaccactgccttggacctcgggagcctcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaggatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggaacacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaagaaaatgattaggccacaacccatggaacacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaattgtgtgaccaccggctaatgtcagctgccatcaaggacagcaaggcagttcacgctgacatggggtactggatagaaagtgaaaagaacgagacctggaagctggcaagagcctcgttcatagaagttaaaacatgtatttggccaaaatcccacactctatggagcaacggagttctggaaagtgaaatgataattccaaagatctatggaggaccaatatctcagcataactacagaccaggatatttcacacaaacggtagggccgtggcacctaggcaagttggaactggattttgacttgtgtgagggtaccacagtcgttgtggatgaacattgtggaaatcgaggaccatctcttaggaccacaacagtcacaggaaagataattcatgaatggtgttgtagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtaatgagatccagatggagtagaaaaatgctgatgactggaacactggctgtgttcctccttctcataatgggacaattgacatggaatgatctgatcagattatgcatcatggttggagccaacgcttccgatagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagttggcccctcaatgaagggatcatggctgttggaatagtcagcatcctactaagttcactcctcaagaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatcccccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaaattaacaattatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcactgatccatccagcatagcggccagagggtacatctcaacccgagtgggcatgggtgaagcagctgcgattttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgggtgattcaattgagcaggaaaacctttgatacagagtaccaaaaaacaaaaaataacgactgggattatgtcgtcacaacagacatctccgaaatgggagcaaatttccgggccgacagggtgatagacccaagacggtgtctgaaaccggtaatactaaaagatggtccagagcgtgtcattctagcaggaccgatgccagtgactgtggccagtgccgcccagaggagaggaagaattggaaggaaccacaataaggaaggtgaccagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcagcggtgttkatgctagtggctcattacrccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatcygaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggcccacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggttcagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagtggagatgactgcgtagtgaaaccaattgatgacaggttcgcgacagccttaacagctctgaatgatatgggaaaagtragaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtatggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctgg

SEQ ID NO: 26 - DNA, 10173 bp, Dengue virus type 2
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtagctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtctgcaggcatgatcattatgctgattccaacagtgatggcgttccatctaaccacacgcaacggagaaccacacatgatcgtcggtatacaggagaaagggaaaagtcttctgttcaaaacagagaatggtgtgaacatgtgcaccctcatggctatggaccttggtgaattgtgtgaagacacaatcacgtacaaatgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtgggttatttggaaagggaggcattgtgacctgtgctatgttcaaatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagctgaattgacaggttatggcaccgtcacgatggagtgctccccgagaacaggcctcgacttcaatgagatggtgttgctgcagatggaaaataaagcttggctggtgcataggcaatggtttctagacctgccattrccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatctttgcggcctcagcccactgagctaaagtattcatggaaaacatggggtaaagcaaaaatgctctctacagaatcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataatcccaaagaatctcgctggaccagtgtctcaacacaactatagaccaggctaccatacacaagtagcaggaccatggcacctaggtaagcttgagatggactttgatttctgcgatggaaccacagtaatagtgactgaggactgcggaaatagaggaccctctttgagaacaactactgcctctggaaaactcataacggaatggtgctgccgatcttgcacattaccacccctaagatacagaggtgagaatgggtgctggtacgggatggaaatcagaccattgaaagagaaagaagaaaatctggttaaytccttggtcacagccggacatgggcaggttgacaatttttcactgggagtcttrggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgacgcgttagccttaggcatgatggtccttaaaatagtaagaaacatggaaaagtatcaattagcagtgactatcatggctatcttgtgcgtcccaaacgcagtgatattgcaaaatgcatggaaagtgagttgcacaatactggcagtggtgtccgtttccccactgtttttracatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctyactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccagycacggcagcagcatggtacctgtgggaagtgaagaaacaacgggccggagtattgtgggacgttccttcacctccacccatgggaaaggctgaactggaagatggagcctacagaatcaagcaaaaagggattcttgggtattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagayaaccccgagatcaaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctcttagaggacttccaataagataccaaaccccagccatcagagctgagcacaccgggcgggaaattgtggatctaatgtgtcatgccacatttaccatgaggctgctgtcaccagttagagtgccaaactataacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagcgcagcacaaagaagagggagaataggaagaaatccaaaaaatgaaaatgaccagtacatatacatgggagaacctttggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaraatgtggaagttgaaatctggacaaaagaaggggaaaggaagaaattgaaacccagatggttggatgctaggatctactctgacccactggcgctaaaggaattcaaagaatttgcagccggaagaaagtctctgaccctgaacctaatcacagaaatgggtaggcttccaacattcatgactcagaagacgagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtrcgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcycataactcttacagcagctctcctcttattggtagcgcattacgccatcattgggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtratgctactaatcctctgcgtgactcaagtattgatgatgaggactacatgggctctgtgtgaggccytaaccttagctacagggcccatctccacactgtgggaaggaaatccaggaaggttctggaacactaccattgcggtgtcaatggctaacatctttagagggagttacctggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaggtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcattccgccagaaaagtgtgacacattgttgtgtgacataggggagtcatcaccaaatcccacagtggaagcaggacgaacactcagagtccttaacttagtagaaaactggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacctacgagccggatgttgacctcggaagcggaacccgaaacattggagttgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgttctccccayggtgacacagatggcaatgacagacacgactccatttggacaacagcgtgtttttaaagaaaaagtggacacgagaacccaagaaccgaaagaaggcacgaagaaactaatgagaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggarccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacatatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaattgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagatttagaagagaagaggaagaagcaggagtcctgtgg

SEQ ID NO: 27 - DNA, 10170 bp, Dengue virus type 3
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcatttatagctttcctcagatttctagccattccaccgacagcaggagtcttggctagatggggtacctttaagaagtcgggggctattaaggtcttaaaaggcttcaagaaggagatctcaaacatgctgagcattatcaacaaacggaaaaagacatcgctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagctatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaagggatgagctatgcaatgtgcttgggtagctttgtgttgaagaaagaagtctccgaaacgcagcatgggacaatactcattaaggttgagtacaaaggggaagatgcaccctgcaagattcctttctccacggaggatggacaaggaaaagctcacaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggctactgccagaggtgtaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattayactctatctgggagccgtggtgcaagctgacatggggtgtgtcataaactggaaaggcaaagaactcaaatgtggaagtggaattttcgtcactaatgaggtccacacctggacagagcaatacaaatttcaagcagactcccccaagagactggcaacagccattgcaggcgcttgggaaaatggagtgtgcggaattaggtcaacaaccagaatggagaacctcttgtggaagcaaatagccaatgaactgaattacatattatgggaaaacaacattaaattaacggtagttgtaggcgacataactggggtcttagagcaagggaaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaggattacgggttcggagttttcacaaccaacatatggctgaaactccgagaggtgtacacccaactatgtgaccataggctaatgtcggcagccgtcaaggatgagagggctgtacatgccgacatgggctattggatagaaagccaaaagaatgggagttggaagctagaaaaagcatccttcatagaggtgaaaacctgcacatggccaaaatcacacactctctggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacggtgtcagggaagttgatacacgaatggtgctgccgctcgtgcacacttcctcccctacgatacatgggagaagacggctgctggtatggcatggaaatcagacccattaatgagaaagaagagaatatggtaaagtctctagcctcagcagggagtggaaaggtggacaacttcacaatgggtgtcttgtgtttggcaatcctctttgaagaggtgatgagaggaaaatttgggaaaaaacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccactcctggctttgggattcttcctgaggaaactgacatctagagaaaatttattgctgggagttgggttggccatggcaacaacgttacgactgccagaggacattgaacagatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagctcaacccctaccactttttattttcagtctgaaagatacactcaaaaggagaagctggccactgaatgagggggtgatggcagttggacttgtgagcattctagctagttctctccttaggaatgatgtgcctatggctggaccattagtggctgggggcttgctgatagcgtgctacgtcataactggcacgtcagcagacctcactgtagaaaaggcagcagatgtaacatgggaggaagaggccgagcaaacaggagtgtcccacaatttaatggtcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcatgtcacaagaggggcagtgttgacacacaatgggaaaagactggaaccaaactgggctagcgtgaaaaaagatctgatttcatacggaggaggatggagattgagtgcacaatggaaaaagggggaggaggtgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaaccagatggaccgacaccagagttggaagaagagatgttcaaaaagcgaaatctaaccataatggatctccatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtcagggttccaaactacaacttgataataatggatgaggcccatttcacagacccagccagtatagcggctagagggtacatatcaactcgtgtaggaatgggagaggcagccgcaattttcatgacagcaacaccccctggaacagctgatgcctttcctcagagcaacgctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggttattcaactcagcaggaagacctttgacacagaatatcaaaagaccaaactgaatgattgggactttgtggtgacaacagacatttcagaaatgggagccaatttcaaagcagatagagtgatcgacccaagaagatgtctcaagccggtgattttgacagatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaaactgagacctaggtggcttgatgcccgcacttattcagatcctttagcactcaaagaattcaaggattttgcagctggcagaaagtcaatcgcccttgatcttgtgacagaaataggaagagtgccttcacacttagcccacagaacgagaaacgccctggataatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcatcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggatgtggacttgcacccagcatcagcctggacattgtacgccgtggccacaacagtaataacaccaatgttgagacacaccatagagaattccacagcaaatgtgtctctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccacccgtgaagctcagaaaaggacagctgctggaataatgaagaatccaacggtggatggaataatgacaatagacctagatcctgtaatatatgattcaaaatttgaaaagcaactaggacaggtcatgctcctggttctgtgtgcagtccaacttttattgatgagaacatcatgggccttgtgtgaagttytaaccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtcattcctgaaggaagagtcatagacctaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagttttgaagatggttgaaccatggctaaagaacaaccagttttgcattaaagtattgaacccatacatgccaactgtgattgagcacttagaaagactacaaaggaaacatggaggaatgcttgtgagaaatccactctcacgaaactccacgcacgaaatgtattggatatccaatggtacaggcaatatcgtctcttcagtcaacatggtatccagattgctactgaacagattcacaatgacacacaggagacccaccatagagaaagatgtggatctaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccattcggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggaattcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaaggcagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacctgcacaatgaggaaaaaatcacacagcagatggaccctgaacacaggcagctagcgaacgctatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggaaaggttaaaaagaatggccatcagcggggatgattgcgttgtgaaaccaatcgacgacagattcgccaatgccctgcttgccctgaacgatatgggaaaggttagaaaggacatacctcaatggcagccatcaaagggatggcatgattggcaacaggtccccttctgctcccaccactttcatgaattgatcatgaaagatggaagaaagttggtagttccctgcagaccccaggacgaactaataggaagagcgagaatctcccaaggagcaggatggagccttagagaaactgcatgtctagggaaagcctacgctcaaatgtgggctctcatgtattttcacagaagagatcttagactagcatccaacgccatatgttcagcagtaccagtccactgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttgg

SEQ ID NO: 28 - DNA, 10161 bp, Dengue virus type 4
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaaaagatggggacagttgaagaaaaataaggccatcaggatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacrtggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccggagtccccagcgagactagcgtctgcaatattgaatgcccacaaagatggggtctgtggaattagatcaaccacgaggctggaaaatgtcatgtggaagcaaataaccaacgagctaaattatgttctctgggaaggaggacatgacctcactgtagtggctggggatgtgaagggggtgttgaccaaaggcaagagagcactcacacccccagtgaatgatctgaaatattcatggaagacatggggaaaagcaaaaatcttcaccccagaagcaagaaatagcacatttttaatagacggaccagacacctccgaatgccccaatgaacgaagagcatggaactttcttgaggtggaagactatggatttggcatgttcacgaccaacatatggatgaaattccgagaaggaagttcagaagtgtgtgaccacaggttaatgtcagcggcaattaaagatcagaaagctgtgcatgctgacatgggttattggatagagagctcaaaaaaccagacctggcagatagagaaagcatctcttattgaagtgaaaacatgtctgtggcccaagacccacacattgtggagcaatggagtgctggaaagccagatgctcattccaaaatcatatgcgggccctttttcacaccacaattaccgccagggctatgccacgcaaaccgtgggcccatggcacttaggcaaattagagatagactttggagaatgccccggaacaacagtcgcaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtaacggccggacagggcacatcagaaactttttctatgggtctgttgtgcctgaccttgtttgtggaagaatgcttgaggagaagagtcactaggaaacacatgatattggttgtggtgatcactctttgtgccatcatcctaggaggcctcacatggatggacttactacgagccctcatcatgttgggggacactatgtctggtagaataggaggacagatccacctagccatcatggcagtgttcaagatgtcaccaggataygtgctgggtgtgtttttaaggaaactcacttcaagagagacagcactaatggtaataggaatggccatgacaacggtgctttcaattccacatgaccttatggaactcattgatggaatatcactggggctaattttgctaaaaatagtgacacattttgacaacacccaagtgggaaccttagccctttccttgaccttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttrgctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttgggaaaactcaggttggagtagggatacacatggaaggtgtatttcacacaatgtggcatgtaacaagaggatcagtgatctgccatgagactgggagattggagccatcttgggctgacgtcaggaatgacatgatatcatacggtgggggatggagacttggagacaaatgggacaaagaagaagatgttcaggtcctcgccatagaaccaggaaaaaatcctaaacatgtccaaacgaaacccggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaaccttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagagttccaaattacaacctcatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctaggagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaaggaataaccaaattttagaagaaaacatggaggttgaaatttggactagagagggagaaaagaaaaagctaaggccaagatggttagatgcacgtgtatacgctgaccccatggctttgaaggatttyaaggagtttgctagtggaaggaagagcataactctcgacatcctaacagagattgccagtttgccaacttacctttcctctagggccaagctcgcccttgataacatagtcatgctccacacaacagaaagaggagggagggcctaccaacacgccctgaacgaactcccggagtcactggaaacacttatgcttgtagctttactaggtgctatgacagcaggtatcttcctgtttttcatgcaagggaaaggaatagggaaattgtcaatgggtttgataaccattgcggtggctagtggcttgttctgggtagcagaaattcaaccccagtggatagcggcctcaatcatactagagttttttctcatggtactgttgataccggaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcggccgtcctaatggggcttggaaaaggatggccgctccacagaatggacctcggtgtgccgctgttagcaatgggatgctattctcaagtgaacccaacaactttgacagcatccttagtcatgctttcagtccattatgcaataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaggtcatgctactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacctggcgggagctggactggctttttcactcataaagaatgtacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagattagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacacyctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaggagcacaaagaaacctggcattatgatcaggaaaacccatacagaacctgggcgtatcatggaagctatgaagctccttcgacaggctctgcatcctccatggtgaacggggtagtaaaactgctaacaaaaccttgggatgtggttccaatggtgacccagttagccatgacagacacaaccccttttgggcaacaaagagtgttcaaagagaaggtggataccagaacaccacaaccaaaacccggtacacgaatggttatgaccacgacagccaattggctgtgggccctccttgggaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaagaactgatcacggaacagatggccccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctggatgagaggtttggcacttccctcctcttcttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatatgctcagcagttccaacggaatggtttccaacaagcagaacaacatggtcaatccacgctcatcatcagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcagaaacctgatcggaaaagaggaatacgtggattacatgccagtaatgaaaagatacagcgctccttcagagagtgaaggagttctg

SEQ ID NO: 29 - DNA, 10176 bp, Dengue virus type 1
atgaacaaccaacgaaaaaagacggctcgaccgtctttcaatatgctgaaacgcgcgagaaaccgcgtgtcaactgtttcacagttggcgaagagattctcaaaaggattgctctcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggaaaagatctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtyaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgraaaaaaratcatggctagtccacaaacaatggtttctagacttaccactgccttggacctcgggagcctcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaggatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggaacacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaagaaaatgattaggccacaacccatggaacacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaattgtgtgaccaccggctaatgtcagctgccatcaaggacagcaaggcagttcacgctgacatggggtactggatagaaagtgaaaagaacgagacctggaagctggcaagagcctcgttcatagaagttaaaacatgtatttggccaaaatcccacactctatggagcaacggagttctggaaagtgaaatgataattccaaagatctatggaggaccaatatctcagcataactacagaccaggatatttcacacaaacggtagggccgtggcacctaggcaagttggaactggattttgacttgtgtgagggtaccacagtcgttgtggatgaacattgtggaaatcgaggaccatctcttaggaccacaacagtcacaggaaagataattcatgaatggtgttgtagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtaatgagatccagatggagtagaaaaatgctgatgactggaacactggctgtgttcctccttctcataatgggacaattgacatggaatgatctgatcagattatgcatcatggttggagccaacgcttccgatagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagttggcccctcaatgaagggatcatggctgttggaatagtcagcatcctactaagttcactcctcaagaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatcccccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaaattaacaattatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcactgatccatccagcatagcggccagagggtacatctcaacccgagtgggcatgggtgaagcagctgcgattttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgggtgattcaattgagcaggaaaacctttgatacagagtaccaaaaaacaaaaaataacgactgggattatgtcgtcacaacagacatctccgaaatgggagcaaatttccgggccgacagggtgatagacccaagacggtgtctgaaaccggtaatactaaaagatggtccagagcgtgtcattctagcaggaccgatgccagtgactgtggccagtgccgcccagaggagaggaagaattggaaggaaccacaataaggaaggtgaccagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcagcggtgttgatgctagtggctcattacrccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggcccacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttaggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggttcagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagtggagatgactgcgtagtgaaaccaattgatgacaggttcgcgacagccttaacagctctgaatgatatgggaaaagtragaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtatggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctgg

SEQ ID NO: 30 - DNA, 10173 bp, Dengue virus type 2
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtagctttccttcgtttcctaacaatcccaccaacagcagggatattgaagagatggggaacaattaaaaaatcaaaagccattaatgttttgagagggttcaggaaagagatcggaaggatgctgaacatcttgaataggagacgcaggtctgcaggcatgatcattatgctgattccaacagtgatggcgttccatctaaccacacgcaacggagaaccacacatgatcgtcggtatacaggagaaagggaaaagtcttctgttcaaaacagagaatggtgtgaacatgtgcaccctcatggctatggaccttggtgaattgtgtgaagacacaatcacgtacaaatgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatcccgttgcccaacacaaggggaacccagcctaraagaagagcaggataagaggttcgtctgcaaacactccatggtagacagaggatggggaaatggatgtgggttatttggaaagggaggcattgtgacctgtgctatgttcaaatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagctgaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggatraacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatctttgcggcctcagcccactgagctaaagtattcatggaaaacatggggtaaagcaaaaatgctctctacagaatcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataatcccaaagaatctcgctggaccagtgtctcaacacaactatagaccaggctaccatacacaagtagcaggaccatggcacctaggtaagcttgagatggactttgatttctgcgatggaaccacagtaatagtgactgaggactgcggaaatagaggaccctctttgagaacaactactgcctctggaaaactcataacggaatggtgctgccgatcttgcacattaccacccctaagatacagaggtgagaatgggtgctggtacgggatggaaatcagaccattgaaagagaaagaagaaaatctggttaaytccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgacgcgttagccttaggcatgatggtccttaaaatagtaagaaacatggaaaagtatcaattagcagtgactatcatggctatcttgtgcgtcccaaacgcagtgatattgcaaaatgcatggaaagtgagttgcacaatactggcagtggtgtccgtttccccactgtttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctyactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccagtcacggcagcagcatggtacctgtgggaagtgaagaaacaacgggccggagtattgtgggacgttccttcacctccacccatgggaaaggctgaactggaagatggagcctacagaatcaagcaaaaagggattcttgggtattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcaaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctcttagaggacttccaataagataccaaaccccagccatcagagctgagcacaccgggcgggaaattgtggatctaatgtgtcatgccacatttaccatgaggctgctgtcaccagttagagtgccaaactataacttgattatcatggacgaagcccatttcacagacccagcaagtatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagcgcagcacaaagaagagggagaataggaagaaatccaaaaaatgaaaatgaccagtacatatacatgggagaacctttggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaraatgtggaagttgaaatctggacaaaagaaggggaaaggaagaaattgaaacccagatggttggatgctaggatctactctgacccactggcgctaaaggaattcaaagaatttgcagccggaagaaagtctctgaccctgaacctaatcacagaaatgggtaggcttccaacattcatgactcagaagacgagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtrcgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcycataactcttayagcagctctcctcttattggtagcgcattacgccatcattgggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtratgctactaatcctctgcgtgactcaagtattgatgatgaggactacatgggctctgtgtgaggccytaaccttagctacagggcccatctccacactgtgggaaggaaatccaggaaggttctggaacactaccattgcggtgtcaatggctaacatctttagagggagttacctggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaggtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcattccgccagaaaagtgtgacacattgttgtgtgacataggggagtcatcaccaaatcccacagtggaagcaggacgaacactcagagtccttaacttagtagaaaactggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacctacgagccggatgttgacctcggaagcggaacccgaaacattggagttgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgttctccccayggtgacacagatggcaatgacagacacgactccatttggacaacagcgtgtttttaaagaaaaagtggacacgagaacccaagaaccgaaagaaggcacgaagaaactaatgagaatcacagcagagtggctgtggaaagaattagggaagaaaaagacacctaggatgtgcaccagagaagaattcacaagaaaggkgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacatatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaattgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagatttagaagagaagaggaagaagcaggagtcctgtgg

SEQ ID NO: 31 - DNA, 10170 bp, Dengue virus type 3; identical to SEQ ID NO: 27

SEQ ID NO: 32 - DNA, 10161 bp, Dengue virus type 4
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaaaagatggggacagttgaagaaaaataaggccatcaggatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacrtggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaagsttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggwatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccggagtccccagcgagactagcgtctgcaatattgaatgcccacaaagatggggtctgtggaattagatcaaccacgaggctggaaaatgtcatgtggaagcaaataaccaacgagctaaattatgttctctgggaaggaggacatgacctcactgtagtggctggggatgtgaagggggtgttgaccaaaggcaagagagcactcacacccccagtgaatgatctgaaatattcatggaagacatggggaaaagcaaaaatcttcaccccagaagcaagaaatagcacatttttaatagacggaccagacacctccgaatgccccaatgaacgaagagcatggaactttcttgaggtggaagactatggatttggcatgttcacgaccaacatatggatgaaattccgagaaggaagttcagaagtgtgtgaccacaggttaatgtcagcggcaattaaagatcagaaagctgtgcatgctgacatgggttattggatagagagctcaaaaaaccagacctggcagatagagaaagcatctcttattgaagtgaaaacatgtctgtggcccaagacccacacattgtggagcaatggagtgctggaaagccagatgctcattccaaaatcatatgcgggccctttttcacaccacaattaccgccagggctatgccacgcaaaccgtgggcccatggcacttaggcaaattagagatagactttggagaatgccccggaacaacagtcgcaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtaacggccggacagggcacatcagaaactttttctatgggtctgttgtgcctgaccttgtttgtggaagaatgcttgaggagaagagtcactaggaaacacatgatattggttgtggtgatcactctttgtgccatcatcctaggaggcctcacatggatggacttactacgagccctcatcatgttgggggacactatgtctggtagaataggaggacagatccacctagccatcatggcagtgttcaagatgtcaccaggataygtgctgggtgtgtttttaaggaaactcacttcaagagagacagcactaatggtaataggaatggccatgacaacggtgctttcaattccacatgaccttatggaactcattgatggaatatcactggggctaattttgctaaaaatagtgacacattttgacaacacccaagtgggaaccttagccctttccttgaccttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttrgctggcccaatggtggcaggaggcttacttctggcggcttacgtgatgagtggtagctcagcagatctgtyactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttkggaaaactcaggttggagtagggatacacatggaaggtgtatttcacacaatgtggcatgtaacaagaggatcagtgatctgccatgagactgggagattggagccatcttgggctgacgtcaggaatgacatgatatcatacggtgggggatggagacttggagacaaatgggacaaagaagaagatgttcaggtcctcgccatagaaccaggaaaaaatcctaaacatgtccaaacgaaacccggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaaccttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagagttccaaattacaacctcatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctaggagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaaggaataaccaaattttagaagaaaacatggaggttgaaatttggactagagagggagaaaagaaaaagctaaggccaagatggttagatgcacgtgtatacgctgaccccatggctttgaaggatttyaaggagtttgctagtggaaggaagagcataactctcgacatcctaacagagattgccagtttgccaacttacctttcctctagggccaagctcgcccttgataacatagtcatgctccacacaacagaaagaggagggagggcctaccaacacgccctgaacgaactcccggagtcactggaaacacttatgcttgtagctttactaggtgctatgacagcaggtatcttcctgtttttcatgcaagggaaaggaatagggaaattgtcaatgggtttgataaccattgcggtggctagtggcttgttctgggtagcagaaattcaaccccagtggatagcggcctcaatcatactagagttttttctcatggtactgttgataccggaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcggccgtcctaatggggcttggaaaaggatggccgctccacagaatggacctcggtgtgccgctgttagcaatgggatgctattctcaagtgaacccaacaactttgacagcatccttagtcatgctttcagtccattatgcaataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaggtcatgctactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacctggcgggagctggactggctttttcactcataaagaatgtacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagattagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacacyctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaggagcacaaagaaacctggcattatgatcaggaaaacccatacagaacctgggcgtatcatggaagctatgaagctccttcgacaggctctgcatcctccatggtgaacggggtagtaaaactgctaacaaaaccttgggatgtggttccaatggtgacccagttagccatgacagacacaaccccttttgggcaacaaagagtgttcaaagagaaggtggataccagaacaccacaaccaaaacccggtacacgaatggttatgaccacgacagccaattggctgtgggccctccttgggaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaagaactgatcacggaacagatggccccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctggatgagaggtttggcacttccctcctcttcttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatatgctcagcagttccaacggaatggtttccaacaagcagaacaacatggtcaatccacgcycatcatcagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcagraacctgatcggaaaagaggaatacgtggattacatgccagtaatgaaaagatacagcgctccttcagagagtgaaggagttctg

The invention claimed is:

1. An attenuated dengue virus (DENV) vaccine composition comprising one or more non-naturally-occurring attenuated DENVs selected from the group consisting of a mixture of attenuated serotype 1 dengue viruses (DENV1), a mixture of attenuated serotype 2 dengue viruses (DENV2), a mixture of attenuated serotype 3 dengue viruses (DENV3), and a mixture of attenuated serotype 4 dengue viruses (DENV4), wherein said vaccine has the following features:

(a) said attenuated DENV1 mixture comprises DENV1 viruses with the following mutations: K482E/K, E483K, K484R/K, K568R, N1663K, I/T2353T, and A2364T/A;

wherein said numbering is based upon the DENV1 parent strain 03135 comprising SEQ ID NO:1;

(b) said attenuated DENV2 mixture comprises DENV2 viruses with the following mutations: D143N, T400K, D1102N, L1308F, E1654K, P2347P/L and T2828T/M;

wherein said numbering is based upon the DENV2 parent strain 99345 comprising SEQ ID NO:2;

(c) said attenuated DENV3 mixture comprises DENV3 viruses with the following mutations: I209L, S582G, K/R671K, A687V, T764I/T, F1211L, A1237T, and Q1563K;

wherein said numbering is based upon the DENV3 parent strain 16562 comprising SEQ ID NO:3; and, (d) said attenuated DENV4 mixture comprises DENV4 viruses with the following mutations: L2187F and F/L2354S, wherein said numbering is based upon the DENV4 parent strain 1036 comprising SEQ ID NO:4.

2. The attenuated tetravalent dengue virus vaccine of claim 1, wherein a mixing ratio of the attenuated serotype 1, 2, 3 and 4 dengue viruses is 1:1:1:1, 5:3:5:3, or 5:3:3:3.

3. The attenuated tetravalent dengue virus vaccine of claim 1, wherein a respective antigenic amount of the attenuated serotype 1, 2, 3 and 4 dengue viruses is 1 to 7 log 10 FFU/dose.

* * * * *